United States Patent
Asmar-Rovira et al.

(10) Patent No.: US 11,473,099 B2
(45) Date of Patent: Oct. 18, 2022

(54) METHODS AND COMPOSITIONS FOR HERBICIDE TOLERANCE IN PLANTS

(71) Applicant: Monsanto Technology LLC, St. Louis, MO (US)

(72) Inventors: Guillermo A. Asmar-Rovira, San Diego, CA (US); Stephen M. Duff, St. Louis, MO (US); Shirley X. Guo, Chesterfield, MO (US); Jingdong Liu, Chesterfield, MO (US); R. Douglas Sammons, Wentzville, MO (US); Lei Shi, San Diego, CA (US)

(73) Assignee: MONSANTO TECHNOLOGY, LLC, St. Louis, MO (US)

( * ) Notice: Subject to any disclaimer, the term of this patent is extended or adjusted under 35 U.S.C. 154(b) by 0 days.

(21) Appl. No.: 16/641,594

(22) PCT Filed: Oct. 26, 2018

(86) PCT No.: PCT/US2018/057755
§ 371 (c)(1),
(2) Date: Feb. 24, 2020

(87) PCT Pub. No.: WO2019/089381
PCT Pub. Date: May 9, 2019

(65) Prior Publication Data
US 2021/0189417 A1    Jun. 24, 2021

Related U.S. Application Data

(60) Provisional application No. 62/580,315, filed on Nov. 1, 2017.

(51) Int. Cl.
*C12N 15/82* (2006.01)
*C12N 9/10* (2006.01)

(52) U.S. Cl.
CPC ....... *C12N 15/8275* (2013.01); *C12N 9/1092* (2013.01); *C12Y 205/01019* (2013.01)

(58) Field of Classification Search
CPC ... C12N 15/8275; C12N 15/00; C12N 15/102
See application file for complete search history.

(56) References Cited

U.S. PATENT DOCUMENTS

| 7,723,575 B2 * | 5/2010 | Alibhai | C12N 15/8275 |
| | | | 800/278 |
| 2016/0186200 A1 | 6/2016 | Watts et al. | |
| 2017/0240916 A1 | 8/2017 | Bundock | |
| 2017/0306349 A1 | 10/2017 | Djukanovic et al. | |

FOREIGN PATENT DOCUMENTS

WO    2001066704    9/2001

OTHER PUBLICATIONS

Molin, William T., Alice A. Wright, and Vijay K. Nandula. "Glyphosate-resistant goosegrass from Mississippi." Agronomy 3.2 (2013): 474-487 (Year: 2013).*
Baerson, Scott R., et al. "Glyphosate-resistant goosegrass. Identification of a mutation in the target enzyme 5-enolpyruvylshikimate-3-phosphate synthase." Plant physiology 129.3 (2002): 1265-1275. In IDS of Jun. 2, 2022. (Year: 2002).*
Huynh et al., "5-Enolpyruvyl Shikimate 3-Phosphate Synthase from *Escherichia coli*, Identification Of Lys-22 As A Potential Active Site Residue" The Journal of Biological Chemistry, Jan. 15, 1988, vol. 263. No. 2, pp. 735-739, 1988; abstract, p. 735, col. 1, para 1.
International Search Report and Written Opinion issued in International Application No. PCT/US2018/057755 dated Apr. 8, 2019, 11 pages.
Sauer et al., "Oligonucleotide-Mediated Genome Editing Provides Precision and Function to Engineered Nucleases and Antibiotics in Plants," Plant Physiology, 2016, 170(4),1917-1928.
Jain et al., "A rapid, efficient, and economical inverse polymerase chain reaction-based method for generating a site saturation mutant library", Analytical Biochemistry, 2013, 449C:90-98.
Baerson, et al., Glyphosate-resistant goosegrass identification of a mutation in the target enzyme 5-enolpyruvylshikimate-3-phosphate synthase, Plant Physiology 129: 1265-1275, 2002.
Extended European Search Report regarding European Application No. 18874261.3, dated Feb. 9, 2022.
Partial Supplementary European Search Report regarding European Application No. 18874261.3, dated Nov. 9, 2021.

* cited by examiner

*Primary Examiner* — Weihua Fan
(74) *Attorney, Agent, or Firm* — Dentons US LLP; Elizabeth Millard

(57) ABSTRACT

The invention relates to novel methods and compositions for conferring tolerance to glyphosate to plants. The invention also provides glyphosate-tolerant plants, seeds, tissue, cells, and plant parts comprising modified EPSP synthases and recombinant DNA molecules encoding modified EPSP synthases, as well as methods of producing the same and the use thereof.

20 Claims, 5 Drawing Sheets

Specification includes a Sequence Listing.

Figure 1

```
             10         20         30         40         50         60
        AGAEEIVLQP IKEISGTVKL PGSKSLSNRI LLLAALSEGT TVVDNLLNSE DVHYMLGALR 70         80         90        100        110        120
        TLGLSVEADK AAKRAVVVGC GGKFPVEDSK EEVQLFLGNA GIAMRPLTAA VTAAGGNATY 130        140        150        160        170        180
        VLDGVPRMRE RPIGDLVVGL KQLGADVDCF LGTDCPPVRV NGIGGLPGGK VKLSGSISSQ 190        200        210        220        230        240
        YLSALLMAAP LALGDVEIEI IDKLISIPYV EMTLRLMERF GVKAEHSDSW DRFYIKGGQK 250        260        270        280        290        300
        YKSPKNAYVE GDASSASYFL AGAAITGGTV TVEGCGTTSL QGDVKFAEVL EMMGAKVTWT 310        320        330        340        350        360
        ETSVTVTGPP REPFGRKHLK AIDVNLNKMP DVAMTLAVVA LFADGPTAIR DVASWRVKET 370        380        390        400        410        420
        ERMVAIRTEL TKLGASVEEG PDYCIITPPE KLNVTAIDTY DDHRMAMAFS LAACAEVPVA 430        440        444
        IRDPGCTRKT FPDYFDVLST FVKN
```

Figure 2

| | Second Base in Codon | | | | |
|---|---|---|---|---|---|
| | U | C | A | G | |
| U | UUU } Phe<br>UUC<br>UUA } Leu<br>UUG | UCU<br>UCC } Ser<br>UCA<br>UCG | UAU } Tyr<br>UAC<br>UAA Stop<br>UAG Stop | UGU } Cys<br>UGC<br>UGA Stop<br>UGG Trp | U<br>C<br>A<br>G |
| C | CUU<br>CUC } Leu<br>CUA<br>CUG | CCU<br>CCC } Pro<br>CCA<br>CCG | CAU } His<br>CAC<br>CAA } Gln<br>CAG | CGU<br>CGC } Arg<br>CGA<br>CGG | U<br>C<br>A<br>G |
| A | AUU<br>AUC } Ile<br>AUA<br>AUG Met or Start | ACU<br>ACC } Thr<br>ACA<br>ACG | AAU } Asn<br>AAC<br>AAA } Lys<br>AAG | AGU } Ser<br>AGC<br>AGA } Arg<br>AGG | U<br>C<br>A<br>G |
| G | GUU<br>GUC } Val<br>GUA<br>GUG | GCU<br>GCC } Ala<br>GCA<br>GCG | GAU } Asp<br>GAC<br>GAA } Glu<br>GAG | GGU<br>GGC } Gly<br>GGA<br>GGG | U<br>C<br>A<br>G |

First Base in Codon (left axis) — Third Base in Codon (right axis)

Figure 4

| | | |
|---|---|---|
| Maize | AGAEEIVLQPIKEISGTVKLPGSKSLSNRILLLAALSEGTTVVDNLLNSEDVHYMLGALR | 60 |
| Rice | AKAEEIVLQPIREISGAVQLPGSKSLSNRILLLSALSEGTTVVDNLLNSEDVHYMLEALK | 60 |
| Wheat | SGAEEVVLQPIREISGAVQLPGSKSLSNRILLLSALSEGTTVVDNLLNSEDVHYMLEALE | 60 |
| Sorghum | AGAEEIVLQPIKEISGTVKLPGSKSLSNRILLLAALSEGTTVVDNLLNSEDVHYMLGALN | 60 |
| Soybean | STSPEIVLEPIKDFSGTITLPGSKSLSNRILLLAALSEGTTVVDNLLYSEDIHYMLGALR | 60 |
| Cotton | SRASEIVLQPINEISGTVKLPGSKSLSNRILLLAALSEGTTVVENLLNSDDVHHMLVALG | 60 |
| Canola | EKASEIVLQPIREISGLIKLPGSKSLSNRILLLAALSEGTTVVDNLLNSDDINYMLDALK | 60 |
| Arabidopsis | EKASEIVLQPIREISGLIKLPGSKSLSNRILLLAALSEGTTVVDNLLNSDDINYMLDALK | 60 |
| | | |
| Maize | TLGLSVEADKAAKRAVVVGCGGKFPVE-DSKEEVQLFLGNAGTAMRPLTAAVTAAGGNAT | 119 |
| Rice | ALGLSVEADKVAKRAVVVGCGGKFPVEKDAKEEVQLFLGNAGTAMRPLTAAVTAAGGNAT | 120 |
| Wheat | ALGLSVEADKVAKRAVVVGCGGRFPVEKDAQEEVKLFLGNAGTAMRPLTAAVVAAGGNAT | 120 |
| Sorghum | TLGLSVEADKVAKRAVVVGCGGKFPVE-DAKEEVQLFLGNAGTAMRPLTAAVTAAGGNAT | 119 |
| Soybean | TLGLRVEDDKTTKQAIVEGCGGLFPTSKESKDEINLFLGNAGTAMRPLTAAVVAAGGNAS | 120 |
| Cotton | KLGLYVKHDSEKKQAIVEGCGGQFPVGKGEGQEIELFLGNAGTAMRPLTAAITAAGGNSS | 120 |
| Canola | KLGLNVERDSVNNRAVVEGCGGIFPASLDSKSDIELYLGNAGTAMRPLTAAVTAAGGNAS | 120 |
| Arabidopsis | ILGLNVETHSENNRAVVEGCGGVFPASIDSKSDIELYLGNAGTAMRPLTAAVTAAGGNAS | 120 |
| | | |
| Maize | YVLDGVPRMRERPIGDLVVGLKQLGADVDCFLGTDCPPVRVNGIGGLPGGKVKLSGSISS | 179 |
| Rice | YVLDGVPRMRERPIGDLVVGLKQLGADVDCFLGTECPPVRVKGIGGLPGGKVKLSGSISS | 180 |
| Wheat | YVLDGVPRMRERPIGDLVVGLQQLGADADCFLGTNCPPVRINGKGGLPGGKVKLSGSISS | 180 |
| Sorghum | YVLDGVPRMRERPIGDLVVGLKQLGADVDCFLGTDCPPVRINGIGGLPGGKVKLSGSISS | 179 |
| Soybean | YVLDGVPRMRERPIGDLVAGLKQLGADVDCFLGTNCPPVRVNGKGGLPGGKVKLSGSVSS | 180 |
| Cotton | YVLDGVPRMRERPIGDLVTGLRQLGADVDCTLGTNCPPVRIEGKGGLPGGKVKLSGSISS | 180 |
| Canola | YVLDGVPRMRERPIGDLVVGLKQLGADVECTLGTNCPPVRVNANGGLPGGKVKLSGSISS | 180 |
| Arabidopsis | YVLDGVPRMRERPIGDLVVGLKQLGADVECTLGTNCPPVRVNANGGLPGGKVKLSGSISS | 180 |
| | | |
| Maize | QYLSALLMAAPLALGDVEIEIIDKLISIPYVEMTLRLMERFGVKAEHSDSWDRFYIKGGQ | 239 |
| Rice | QYLSALLMAAPLALGDVEIEIIDKLISIPYVEMTLRLMERFGVKAEHSDSWDRFYIKGGQ | 240 |
| Wheat | QYLSSLLMAAPLALEDVEIEIIDKLISVPYVEMTLKLMERFGVTAEHSDSWDRFYIKGGQ | 240 |
| Sorghum | QYLSALLMAAPLALGDVEIEIIDKLISIPYVEMTLRLMERFGVKAEHSDSWDRFYIKGGQ | 239 |
| Soybean | QYLTALLMAAPLALGDVEIEIVDKLISVPYVEMTLKLMERFGVSEHSGNWDRFLVHGGQ | 240 |
| Cotton | QYLTALLMAAPLALGDVEIEIIDKLISIPYVEMTIKLMERFGVTVEHTDSWDRFFIRGGQ | 240 |
| Canola | QYLTALLMAAPLALGDVEIEIIDKLISVPYVEMTLKLMERFGVSAEHSDSWDRFFVKGGQ | 240 |
| Arabidopsis | QYLTALLMAAPLALGDVEIEIVDKLISVPYVEMTLKLMERFGVSAEHSESWDRFFVKGGQ | 240 |

FIGURE 4 continued

```
Maize       KYKSPKNAYVEGDASSASYFLAGAAITGGTVTVEGCGTTSLQGDVKFAEVLEMMGAKVTW   299
Rice        KYKSPGNAYVEGDASSASYFLAGAAITGGTVTVQGCGTTSLQGDVKFAEVLEMMGAKVTW   300
Wheat       KYKSPGNAYVEGDASSASYFLAGAAITGGTVTVEGCGTTSLQGDVKFAEVLEMMGAKVTW   300
Sorghum     KYKSPKNAYVEGDASSASYFLAGAAITGGTVTVEGCGTTSLQGDVKFAEVLEMMGAKVTW   299
Soybean     KYKSPGNAFVEGDASSASYLLAGAAITGGTITVNGCGTSSLQGDVKFAEVLEKMGAKVTW   300
Cotton      KYMSPGNAYVEGDASSASYFLAGAAVTGGTVTVEGCGTSSLQGDVKFAEVLEMMGAKVTW   300
Canola      KYKSPGNAYVEGDASSASYFLAGAAITGETVTVEGCGTTSLQGDVKFAEVLEKMGCKVSW   300
Arabidopsis KYKSPGNAYVEGDASSASYFLAGAAITGETVTVEGCGTTSLQGDVKFAEVLEKMGCKVSW   300

Maize       TETSVTVTGPPREPFGRKHLKAIDVNMNKMPDVAMTLAVVALFADGPTAIRDVASWRVKE   359
Rice        TDTSVTVTGPPREPYGKKHLKAVDVNMNKMPDVAMTLAVVALFADGPTAIRDVASWRVKE   360
Wheat       TDTSVTVTGPPRQPFGRKHLKAVDVNMNKMPDVAMTLAVVALFADGPTAIRDVASWRVKE   360
Sorghum     TETSVTVTGPPRQPFGRKHLKAIDVNMNKMPDVAMTLAVVALFANGPTAIRDVASWRVKE   359
Soybean     SENSVTVSGPPRDFSGRKVLRGIDVNMNKMPDVAMTLAVVALFANGPTAIRDVASWRVKE   360
Cotton      TKNSVTVTGPPRNPSGRKHLRAIDVNMNKMPDVAMTLAVVALYADGPTAIRDVASWRVKE   360
Canola      TENSVTVTGPSRDAFGMRHLRAVDVNMNKMPDVAMTLAVVALFADGPTTIRDVASWRVKE   360
Arabidopsis TENSVTVTGPSRDAFGMRHLRAIDVNMNKMPDVAMTLAVVALFADGPTTIRDVASWRVKE   360

Maize       TERMVAIRTELTKLGASVEEGPDYCIITPPEKLNVTAIDTYDDHRMAMAFSLAACAEVPV   419
Rice        TERMVAIRTELTKLGASVEEGPDYCIITPPEKLNITAIDTYDDHRMAMAFSLAACADVPV   420
Wheat       TERMVAIRTELTKLGATVEEGPDYCIITPPEKLNITAIDTYDDHRMAMAFSLAACAEVPV   420
Sorghum     TERMVAIRTELTKLGASVEEGPDYCIITPPEKLNVTAIDTYDDHRMAMAFSLAACAEVPV   419
Soybean     TERMIAICTELRKLGATVEEGPDYCVITPPEKLNVTAIDTYDDHRMAMAFSLAACGDVPV   420
Cotton      TERMIAICTELRKLGATVEEGPDFCVITPPEKLNVTAIDTYDDHRMAMAFSLAACAEVPV   420
Canola      TERMIAICTELRKLGATVEEGSDYCVITPPAKVKPAEIDTYDDHRMAMAFSLAACADVPV   420
Arabidopsis TERMIAICTELRKLGATVEEGSDYCVITPPKKVKPAEIDTYDDHRMAMAFSLAACADVPI   420

Maize       AIRDPGCTRKTFPDYFDVLSTFVKN   444
Rice        TIRDPGCTRKTFPNYFDVLSTFVRN   445
Wheat       TIRDPGCTRKTFPNYFDVLSTFVKN   445
Sorghum     TIRDPGCTRKTFPDYFDVLSTFVKN   444
Soybean     TIKDPGCTRKTFPDYFEVLERLTKH   445
Cotton      TIRDPGCTRKTFPDYFEVLARVTKH   445
Canola      TIKDPGCTRKTFPDYFQVLESITKH   445
Arabidopsis TINDPGCTRKTFPDYFQVLERITKH   445
```

METHODS AND COMPOSITIONS FOR HERBICIDE TOLERANCE IN PLANTS

CROSS-REFERENCE TO RELATED APPLICATIONS

This application is a 371 National Stage application of International Application No. PCT/US2018/057755, filed Oct. 26, 2018, which claims the benefit of priority of U.S. Provisional Application No. 62/580,315, filed Nov. 1, 2017, the disclosure each of which is hereby incorporated by reference in its entirety.

FIELD OF THE INVENTION

The present disclosure relates to the field of biotechnology. More specifically, the disclosure relates to recombinant DNA molecules encoding engineered 5-enolpyruvylshikimate-3-phosphate synthase (EPSPS) enzymes that provide tolerance to the herbicide glyphosate.

INCORPORATION OF SEQUENCE LISTING

The sequence listing that is contained in the file named MONS427WO_ST25.txt, which is 1,562 kilobytes (measured in MS-WINDOWS) and created on Oct. 10, 2018, is filed herewith by electronic submission and incorporated herein by reference.

BACKGROUND OF THE INVENTION

Glyphosate, or N-phosphonomethylglycine, is a broad-spectrum, foliar-applied herbicide that inhibits 5-enolpyruvylshikimate-3-phosphate synthase (EPSP synthase or EPSPS) in plants. EPSPS is part of the shikimate pathway used in plants for the biosynthesis of folates and aromatic amino acids. EPSPS from different organisms have been divided into two classes based on glyphosate sensitivity. All plants have class I EPSP synthases, which are glyphosate-sensitive. Glyphosate tolerant crops have been produced using the glyphosate-insensitive class II EPSPS from *Agrobacterium* sp. strain CP4 or using the T97I-P101S double mutation of the class I EPSPS from maize. Glyphosate tolerance in crops permits the use of glyphosate to control weeds while maintaining crop yield. Plant EPSPS variants with improved tolerance to glyphosate are useful to produce such crops and find use with both the tools of transgenic crop production and the tools of genome editing. Thus, there is a need for improved glyphosate-tolerant EPSP synthases, glyphosate-tolerant plants, and their methods of use.

SUMMARY OF THE INVENTION

The invention provides a recombinant DNA molecule encoding a glyphosate-tolerant EPSPS, wherein the EPSPS comprises at least a first amino acid substitution selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1. In one embodiment, the glyphosate-tolerant EPSPS is a glyphosate-tolerant maize EPSPS. In another embodiment, the recombinant DNA molecule encodes a glyphosate-tolerant EPSPS that comprises at least 2, at least 3, at least 4, at least 5, at least 6, or at least 7 amino acid substitutions. In another embodiment, the recombinant DNA molecule encodes a glyphosate-tolerant EPSPS that comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-

L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

In another embodiment, the recombinant DNA molecule encodes a glyphosate-tolerant EPSPS that confers increased tolerance to glyphosate as compared to a wild-type EPSPS. In yet another embodiment, the recombinant DNA molecule encodes a glyphosate-tolerant maize EPSPS that confers increased tolerance to glyphosate as compared to a wild-type maize EPSPS.

The invention provides a plant, seed, plant tissue, plant part, or cell comprising a recombinant DNA molecule encoding a glyphosate-tolerant EPSPS, wherein the EPSPS comprises at least a first amino acid substitution selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114A, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1. In one embodiment, the plant, seed, plant tissue, plant part, or cell comprises a recombinant DNA molecule encoding a glyphosate-tolerant EPSPS, wherein the EPSPS comprises at least 2, at least 3, at least 4, at least 5, at least 6, or at least 7 amino acid substitutions. In another embodiment, the plant, seed, plant tissue, plant part, or cell comprises a recombinant DNA molecule encoding a glyphosate-tolerant EPSPS that comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-

E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

The invention provides a plant, seed, plant tissue, plant part, or cell comprising a glyphosate-tolerant EPSPS encoded by a recombinant DNA molecule, wherein the EPSPS comprises at least a first amino acid substitution selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1.

The invention provides a glyphosate-tolerant EPSPS comprising at least a first amino acid substitution selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1. In one embodiment, the glyphosate-tolerant EPSPS comprises at least 2 amino acid substitutions. In another embodiment, the glyphosate-tolerant EPSPS comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-

L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T. In another embodiment, the glyphosate-tolerant EPSPS confers increased tolerance to glyphosate as compared to a wild-type EPSPS.

The invention provides a method for conferring glyphosate tolerance to a plant comprising expressing in the plant the glyphosate-tolerant EPSPS of the invention.

The invention provides a method for producing a glyphosate-tolerant EPSPS comprising introducing into a plant EPSPS at least a first amino acid substitution selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1. In one embodiment, the method comprises introducing at least 2, at least 3, at least 4, at least 5, at least 6, or at least 7 amino acid substitutions into a plant EPSPS. In another embodiment, the method comprises introducing into a plant EPSPS an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

The invention provides a method for producing a glyphosate-tolerant plant comprising: (i) introducing into the genome of a plant cell one or more changes to encode a glyphosate-tolerant EPSPS, wherein the EPSPS comprises at least a first amino acid substitution selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1; and (ii) regenerating a glyphosate-tolerant plant from the plant cell. In one embodiment, the method comprises introducing at least 2, at least 3, at least 4, at least 5, at least 6, or at least 7 amino acid substitutions. In another embodiment, the glyphosate-tolerant EPSPS comprises an amino acid substitution combination selected from the group consisting of: A103P-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-

A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

The invention also provides a method for controlling weeds in a plant growth area, comprising contacting a plant growth area comprising a plant or seed comprising the recombinant DNA molecules provided herein with glyphosate, wherein the plant or seed is tolerant to glyphosate, and wherein weeds are controlled in the plant growth area.

BRIEF DESCRIPTION OF THE DRAWINGS

FIG. 1: Shows the maize EPSPS amino acid sequence with relevant amino acid positions indicated.

FIG. 2: Shows the universal genetic code chart showing all possible mRNA triplet codons (where T in the DNA molecule is replaced by U in the RNA molecule) and the amino acid encoded by each codon.

FIG. 4: Shows a sequence alignment of EPSPS amino acid sequences from eight representative plant species: four monocots (maize, rice, wheat, and *sorghum*) and four dicots (soybean, cotton, canola, and *Arabidopsis*), generated using CLUSTAL 0 (1.2.4). The sequence designated as maize in the alignment corresponds to SEQ ID NO:1.

BRIEF DESCRIPTION OF THE SEQUENCES

Figure 3:
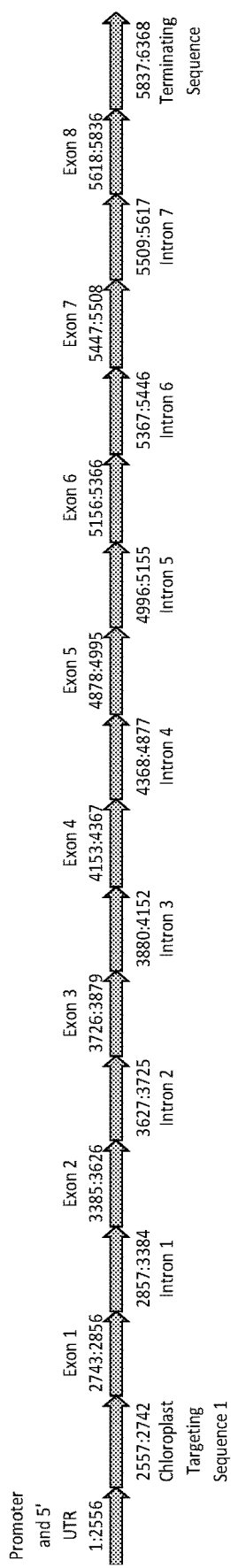
FIG. 3: Shows a diagrammatic representation of the genomic DNA sequence encoding the wild-type maize EPSPS (including the wild-type promoter, transit peptide, introns, exons, and 3' UTR) provided as SEQ ID NO:319. The promoter and 5' UTR are nucleotides 1:2556; the chloroplast transit sequence is nucleotides 2557:2742; EXON 1 is nucleotides 2743:2856; INTRON 1 is nucleotides 2857:3384; EXON 2 is nucleotides 3385:3626; INTRON 2 is nucleotides 3627:3725; EXON 3 is nucleotides 3726:3879; INTRON 3 is nucleotides 3880:4152; EXON 4 is nucleotides 4153:4367; INTRON 4 is nucleotides 4368:4877; EXON 5 is nucleotides 4878:4995; INTRON 5 is nucleotides 4996:5155; EXON 6 is nucleotides 5156:5366; INTRON 6 is nucleotides 5367:5446; EXON 7 is nucleotides 5447:5508; INTRON 7 is nucleotides 5509:5617; EXON 8 is nucleotides 5618:5836; and the 3' UTR is nucleotides 5837:6368.

SEQ ID NO:1 is the amino acid sequence of the wild-type maize EPSPS.

SEQ ID NOs:2-317 and 320-412 are amino acid sequences of recombinant or engineered maize EPSP synthases.

SEQ ID NO:318 is the DNA sequence encoding the wild-type maize EPSPS.

SEQ ID NO:319 is the genomic DNA sequence encoding the wild-type maize EPSPS (including the wild-type promoter, transit peptide, introns, exons, and 3' UTR). The promoter and 5' UTR are nucleotides 1:2556; the chloroplast transit sequence is nucleotides 2557:2742; EXON 1 is nucleotides 2743:2856; INTRON 1 is nucleotides 2857:3384; EXON 2 is nucleotides 3385:3626; INTRON 2 is nucleotides 3627:3725; EXON 3 is nucleotides 3726:3879; INTRON 3 is nucleotides 3880:4152; EXON 4 is nucleotides 4153:4367; INTRON 4 is nucleotides 4368:4877; EXON 5 is nucleotides 4878:4995; INTRON 5 is nucleotides 4996:5155; EXON 6 is nucleotides 5156:5366; INTRON 6 is nucleotides 5367:5446; EXON 7 is nucleotides 5447:5508; INTRON 7 is nucleotides 5509:5617; EXON 8 is nucleotides 5618:5836; and the 3' UTR is nucleotides 5837:6368.

DETAILED DESCRIPTION

The following definitions and methods are provided to better define the invention and to guide those of ordinary skill in the art in the practice of the invention. Unless otherwise noted, terms are to be understood according to conventional usage by those of ordinary skill in the relevant art.

The present invention overcomes the limitations known in the art by providing novel, engineered EPSP synthases that are tolerant to glyphosate and the recombinant DNA molecules that encode them as well as compositions and methods for using and producing the same. Cells, plants, and seeds expressing engineered EPSP synthases of the present invention demonstrate improved glyphosate tolerance and are useful in the methods of agriculture, such as weed control and crop production.

The invention provides novel, engineered proteins and the recombinant DNA molecules that encode them. As used herein, the term "engineered" refers to a non-natural DNA, protein, cell, or organism that would not normally be found in nature and was created by human intervention. An "engineered protein," "engineered enzyme," or "engineered EPSPS," refers to a protein, enzyme or EPSPS whose amino acid sequence was conceived of and created in the laboratory using one or more of the techniques of biotechnology, protein design, or protein engineering, such as molecular biology, protein biochemistry, bacterial transformation, plant transformation, site-directed mutagenesis, directed evolution using random mutagenesis, genome editing, gene cloning, DNA ligation, DNA synthesis, protein synthesis, and DNA shuffling. For example, an engineered protein may have one or more deletions, insertions, or substitutions relative to the wild-type amino acid sequence of the protein and each deletion, insertion, or substitution may consist of one or more amino acids. For example, genetic engineering can be used to create a DNA molecule encoding an engineered protein, such as an engineered EPSPS that is glyphosate tolerant and comprises at least a first amino acid substitution relative to a wild-type EPSPS protein as described herein.

Examples of engineered proteins provided herein are maize EPSP synthases comprising one or more amino acid substitution(s) chosen from I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, including all possible combinations thereof, wherein the position of the amino acid substitution(s) is relative to the amino acid position set forth in SEQ ID NO:1.

In specific embodiments, an engineered protein provided herein comprises one, two, three, four, five, six, seven, eight, nine, ten, or more of any combination of such substitutions. Examples of such combinations include, but are not limited to: A103G-P106L-L107M, A71M-T102G-P106S, A71M-T102G-P106W, A71M-T102I-P106A, E38F-T102G-P106S, E38F-T102G-P106W, E50F-T102G-P106S, E50F-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-

L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A 103C-P106W-G115S, T17M-N28Q-R60K-A71M-T102G-A103V-P106S-L107V-K203A-T269C-E378L, G101A-G144D, and G101A-A192T.

In one embodiment, engineered proteins provided by the invention are EPSP synthases conferring tolerance to glyphosate. As used herein, "EPSPS" means 5-enolpyruvylshikimate-3-phosphate synthase. EPSPS catalyzes the transfer of the enolpyruvyl moiety of phosphoenolpyruvate (PEP) to the 5-hydroxyl of 3-phosphoshikimate (S3P) to produce phosphate and 5-enolpyruvylshikimate-3-phosphate (EPSP). This reaction is part of the biosynthesis of aromatic amino acids via the shikimate pathway in bacteria, fungi, and plants. Glyphosate is a competitive inhibitor of PEP that when bound to EPSPS inhibits catalysis blocking the shikimate pathway.

Engineered proteins may be produced by changing or modifying a wild-type protein to produce a new protein with modified characteristic(s), for example, a novel combination of useful protein characteristics, such as altered $V_{max}$, $K_m$, $K_i$, $IC_{50}$, substrate specificity, inhibitor/herbicide specificity, substrate selectivity, the ability to interact with other components in the cell such as partner proteins or membranes, and protein stability, among others.

Changes may be made at a specific amino acid position in a protein by substituting an alternate amino acid for the amino acid found in that position in the wild-type protein sequence. As used herein, the term "substitution" or "substituting" refers to replacing one amino acid with another amino acid. A substitution is indicated in standard scientific nomenclature by X #Y (where X is the original or wild-type amino acid, # is the amino acid position in the protein's amino acid sequence, and Y is the amino acid to be substituted for X). DNA sequences encoding EPSP synthases with the amino acid substitution(s) described herein can be produced by introducing changes into the DNA sequence encoding the EPSPS using methods known in the art and the information provided in FIG. 2. EPSPS sequences from different plant species can be aligned and compared with SEQ ID NO:1 using standard bioinformatic and sequence analysis tools, such as the Clustal software tools or implementations of the NeedlemanWunsch or the SmithWaterman algorithms. For example, FIG. 4 shows such an alignment prepared using Clustal software. As seen in FIG. 4, the EPSPS sequences of a diverse group of eight representative plant species: four monocots (maize, rice, wheat, and *sorghum*) and four dicots (soybean, cotton, canola, and *Arabidopsis*) sequence can be compared. The substitution(s) provided herein thus can be made in any plant EPSP synthases by aligning the amino acid sequence of the target plant EPSPS with SEQ ID NO:1, identifying the equivalent position of the amino acid for the desired substitution in the target EPSPS sequence relative to the specific amino acid position set forth in SEQ ID NO:1, and making the substation using the methods provided herein.

Amino acid changes may be made as a single amino acid substitution in the protein or in combination with one or more other change(s) or mutation(s), such as one or more other amino acid substitution(s), deletion(s), or addition(s). A protein can be changed or modified by one or more substitutions that are made to the amino acid sequence relative to a reference sequence, such as the wild-type sequence, by changing the DNA sequence encoding the protein. Changes or modifications may be made by any method known to those of skill in the art. Exemplary amino acid positions relative to the protein sequence of wild-type maize EPSPS (SEQ ID NO:1) that are useful for protein engineering are depicted in FIG. 1. In one embodiment, the invention therefore provides an engineered protein, such as an EPSPS having one or more amino acid substitution(s) chosen from I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, and combinations thereof, wherein the position of the amino acid substitution(s) is relative to the amino acid position set forth in SEQ ID NO:1. In specific embodiments, an engineered protein provided herein comprises one, two, three, four, five, six, seven, eight, nine, ten, or more of any combination of such substitutions. Amino acid sequences of recombinant or engineered maize EPSP synthases are provided in Table 1.

TABLE 1

Amino Acid Sequences of Recombinant or Engineered Maize EPSP synthases.

| SEQUENCE | VARIANT |
|---|---|
| 1 | Wild-type Maize EPSPS Protein Sequence |
| 2 | A103F |
| 3 | A103V |
| 4 | A114K |
| 5 | A295F |
| 6 | A340Y |
| 7 | A35M |
| 8 | A58I |
| 9 | A71M |
| 10 | A71M-T102G-P106S |
| 11 | A71M-T102G-P106W |
| 12 | A71M-T102I-P106A |
| 13 | C426M |
| 14 | D331M |
| 15 | E130R |
| 16 | E378L |
| 17 | E378W |
| 18 | E38F |
| 19 | E38F-T102G-P106S |
| 20 | E38F-T102G-P106W |
| 21 | E50F |
| 22 | E50F-T102G-P106S |
| 23 | E50F-T102G-P106W |
| 24 | E50F-T102I-P106A |
| 25 | E67C |

TABLE 1-continued Amino Acid Sequences of Recombinant or Engineered Maize EPSP synthases.

| SEQUENCE | VARIANT |
|---|---|
| 26 | G101E-T102G-P106S |
| 27 | G101E-T102G-P106W |
| 28 | G101E-T102I-P106A |
| 29 | G194Q |
| 30 | G315K |
| 31 | G39K-T102I-P106A |
| 32 | G39W |
| 33 | G39W-T102G-P106S |
| 34 | G39W-T102G-P106W |
| 35 | G63L-T102I-P106A |
| 36 | G82Q |
| 37 | I6P |
| 38 | I6P-R60E-T102G-P106S-E130R |
| 39 | I6P-R60E-T102G-P106S-E130R-E378L |
| 40 | I6P-R60E-T102G-P106S-E130R-L280D |
| 41 | I6P-R60E-T102G-P106S-E378L |
| 42 | I6P-R60E-T102G-P106S-L280D |
| 43 | I6P-R60E-T102G-P106S-L280D-E378L |
| 44 | I6P-R60E-T102G-P106W |
| 45 | I6P-R60E-T102G-P106W-E130R |
| 46 | I6P-R60E-T102G-P106W-E130R-E378L |
| 47 | I6P-R60E-T102G-P106W-E130R-L280D |
| 48 | I6P-R60E-T102G-P106W-E378L |
| 49 | I6P-R60E-T102G-P106W-L280D |
| 50 | I6P-R60E-T102G-P106W-L280D-E378L |
| 51 | I6P-T102G-P106S |
| 52 | I6P-T102G-P106S-E130R |
| 53 | I6P-T102G-P106S-E130R-E378L |
| 54 | I6P-T102G-P106S-E130R-L280D |
| 55 | I6P-T102G-P106S-E130R-L280D-E378L |
| 56 | I6P-T102G-P106S-E378L |
| 57 | I6P-T102G-P106S-L280D |
| 58 | I6P-T102G-P106S-L280D-E378L |
| 59 | I6P-R60E-T102G-P106S |
| 60 | I6P-T102G-P106W |
| 61 | I6P-T102G-P106W-E130R |
| 62 | I6P-T102G-P106W-E130R-E378L |
| 63 | I6P-T102G-P106W-E130R-L280D |
| 64 | I6P-T102G-P106W-E130R-L280D-E378L |
| 65 | I6P-T102G-P106W-E378L |
| 66 | I6P-T102G-P106W-L280D |
| 67 | I6P-T102G-P106W-L280D-E378L |
| 68 | I6W |
| 69 | K170V |
| 70 | K203A |
| 71 | K328F |
| 72 | K70L-T102G-P106S |
| 73 | K70L-T102G-P106W |
| 74 | K70L-T102I-P106A |
| 75 | K70W |
| 76 | K70W-T102G-P106S |
| 77 | K70W-T102G-P106W |
| 78 | K73P-T102G-P106S |
| 79 | K73P-T102G-P106W |
| 80 | K73P-T102I-P106A |
| 81 | L107T |
| 82 | L191D |
| 83 | L280D |
| 84 | L280R |
| 85 | L33E-T102I-P106A |
| 86 | L36E |
| 87 | L36E-T102G-P106S |
| 88 | L36E-T102G-P106W |
| 89 | L46C-T102I-P106A |
| 90 | L46D |
| 91 | L46D-T102G-P106S |
| 92 | L46D-T102G-P106W |
| 93 | L46D-T102I-P106A |
| 94 | L46W-T102I-P106A |
| 95 | L56E-T102G-P106S |
| 96 | L56E-T102G-P106W |
| 97 | L56E-T102I-P106A |
| 98 | L56K-T102G-P106S |
| 99 | L56K-T102G-P106W |
| 100 | L56K-T102I-P106A |
| 101 | L62F-T102G-P106S |
| 102 | L62F-T102G-P106W |
| 103 | L62F-T102I-P106A |
| 104 | L64G-T102G-P106S |
| 105 | L64G-T102G-P106W |
| 106 | L64G-T102I-P106A |
| 107 | M326A |
| 108 | N161W |
| 109 | N28A |
| 110 | N28A-T102G-P106S |
| 111 | N28A-T102G-P106W |
| 112 | N28A-T102I-P106A |
| 113 | N28C-T102G-P106S |
| 114 | N28C-T102G-P106W |
| 115 | N28C-T102I-P106A |
| 116 | N28G |
| 117 | N28G-T102G-P106S |
| 118 | N28G-T102G-P106W |
| 119 | N28G-T102I-P106A |
| 120 | N28M |
| 121 | N28M-T102G-P106S |
| 122 | N28M-T102G-P106W |
| 123 | N28M-T102I-P106A |
| 124 | N28Q |
| 125 | N28Q-T102G-P106S |
| 126 | N28Q-T102G-P106W |
| 127 | N28Q-T102I-P106A |
| 128 | N28S-T102G-P106S |
| 129 | N28S-T102G-P106W |
| 130 | N28S-T102I-P106A |
| 131 | N28T |
| 132 | N28T-T102G-P106S |
| 133 | N28T-T102G-P106W |
| 134 | N28T-T102I-P106A |
| 135 | N28V-T102G-P106S |
| 136 | N28V-T102G-P106W |
| 137 | N28V-T102I-P106A |
| 138 | N45G-T102-P106A |
| 139 | P106A |
| 140 | P132D |
| 141 | R219F |
| 142 | R350K |
| 143 | R60E |
| 144 | R60E-T102G-P106S |
| 145 | R60E-T102G-P106S-E130R-E378L |
| 146 | R60E-T102G-P106S-E130R-L280D |
| 147 | R60E-T102G-P106S-E130R-L280D-E378L |
| 148 | R60E-T102G-P106S-L280D |
| 149 | R60E-T102G-P106S-L280D-E378L |
| 150 | R60E-T102G-P106W |
| 151 | R60E-T102G-P106W-E130R |
| 152 | R60E-T102G-P106W-E130R-E378L |
| 153 | R60E-T102G-P106W-E130R-L280D |
| 154 | R60E-T102G-P106W-E130R-L280D-E378L |
| 155 | R60E-T102G-P106W-E378L |
| 156 | R60E-T102G-P106W-L280D |
| 157 | R60E-T102G-P106W-L280D-E378L |
| 158 | R60E-T102I-P106A |
| 159 | R60K |
| 160 | R60K-T102G-P106S |
| 161 | R60K-T102G-P106W |
| 162 | R60Q-T102I-P106A |
| 163 | S179I |
| 164 | S65K |
| 165 | S65K-T102G-P106S |
| 166 | S65K-T102G-P106W |
| 167 | S65Q-T102I-P106A |
| 168 | S65R-T102G-P106S |
| 169 | S65R-T102G-P106W |
| 170 | S65R-T102I-P106A |
| 171 | T102F |
| 172 | T102G-A103C-P106W |
| 173 | T102G-A103D-P106S |
| 174 | T102G-A103D-P106W |
| 175 | T102G-A103V-P106S-L107V |

TABLE 1-continued

Amino Acid Sequences of Recombinant or Engineered Maize EPSP synthases.

| SEQUENCE | VARIANT |
|---|---|
| 176 | T102G-P106S |
| 177 | T102G-P106S-A114K |
| 178 | T102G-P106S-A295F |
| 179 | T102G-P106S-E130R |
| 180 | T102G-P106S-E130R-E378L |
| 181 | T102G-P106S-E130R-L280D |
| 182 | T102G-P106S-E130R-L280D-E378L |
| 183 | R60E-T102G-P106S-E130R |
| 184 | T102G-P106S-E378L |
| 185 | T102G-P106S-E379M |
| 186 | T102G-P106S-G194Q |
| 187 | T102G-P106S-K203A |
| 188 | T102G-P106S-L107K |
| 189 | T102G-P106S-L280D |
| 190 | T102G-P106S-L280D-E378L |
| 191 | T102G-P106S-L280R |
| 192 | T102G-P106S-N161W |
| 193 | T102G-P106S-P132D |
| 194 | T102G-P106S-P418G |
| 195 | T102G-P106S-S179I |
| 196 | T102G-P106S-T112V |
| 197 | T102G-P106S-T269C |
| 198 | T102G-P106S-T307W |
| 199 | T102G-P106S-V111N |
| 200 | T102G-P106S-V160P |
| 201 | T102G-P106S-V297Q |
| 202 | T102G-P106S-V332K |
| 203 | T102G-P106S-Y383E |
| 204 | Y54G-T102G-P106S |
| 205 | T102G-P106W |
| 206 | T102G-P106W-A114K |
| 207 | T102G-P106W-A295F |
| 208 | T102G-P106W-E130R |
| 209 | T102G-P106W-E130R-E378L |
| 210 | T102G-P106W-E130R-L280D |
| 211 | T102G-P106W-E130R-L280D-E378L |
| 212 | T102G-P106W-E378L |
| 213 | T102G-P106W-E379M |
| 214 | T102G-P106W-G194Q |
| 215 | T102G-P106W-K203A |
| 216 | T102G-P106W-L107K |
| 217 | T102G-P106W-L280D |
| 218 | T102G-P106W-L280D-E378L |
| 219 | T102G-P106W-L280R |
| 220 | T102G-P106W-N161W |
| 221 | T102G-P106W-P132D |
| 222 | T102G-P106W-P418G |
| 223 | T102G-P106W-S179I |
| 224 | T102G-P106W-T112V |
| 225 | T102G-P106W-T269C |
| 226 | T102G-P106W-T307W |
| 227 | T102G-P106W-V111N |
| 228 | T102G-P106W-V160P |
| 229 | T102G-P106W-V297Q |
| 230 | T102G-P106W-V332K |
| 231 | T102G-P106W-Y383E |
| 232 | T102G-R105A-P106S |
| 233 | T102G-R105A-P106W |
| 234 | T102I |
| 235 | T102I-P106S-L107G |
| 236 | T102I-A103D-P106A |
| 237 | T102I-A103V-P106G-L107T |
| 238 | T102I-A103V-P106S |
| 239 | T102I-P106A |
| 240 | T102I-P106A-A114C |
| 241 | T102I-P106A-A118F |
| 242 | T102I-P106A-E288I |
| 243 | T102I-P106A-E379M |
| 244 | T102I-P106A-G124K |
| 245 | T102I-P106A-L107K |
| 246 | T102I-P106A-L122D |
| 247 | T102I-P106A-L280R |
| 248 | T102I-P106A-P418G |
| 249 | T102I-P106A-S179I |
| 250 | T102I-P106A-T112V |
| 251 | T102I-P106A-T112W |
| 252 | T102I-P106A-T307W |
| 253 | T102I-P106A-Y838E |
| 254 | T102I-P106S |
| 255 | T102I-P106T |
| 256 | T102I-R105A-P106A |
| 257 | T102L-A103L-P106S-L107W |
| 258 | T102L-A103L-P106V-L107Q |
| 259 | T102L-A103V-P106C-L107C |
| 260 | T102L-A103V-P106Q-L107S |
| 261 | T102L-A103V-P106S-L107G |
| 262 | T102L-A103V-P106S-L107M |
| 263 | T102L-P106V |
| 264 | T102Q-A103P-P106A-L107F |
| 265 | P106I-L107S |
| 266 | A103G-P106L-L107M |
| 267 | T102V-P106S-L107A |
| 268 | T102V-A103I-P106T-L107C |
| 269 | T102V-A103V-P106A-L107Q |
| 270 | T102V-A103V-P106C-L107F |
| 271 | T102V-P106S |
| 272 | T17M |
| 273 | T269C |
| 274 | T307W |
| 275 | T41H |
| 276 | T41H-T102G-P106S |
| 277 | T41H-T102G-P106W |
| 278 | T61E |
| 279 | T61E-T102G-P106S |
| 280 | T61E-T102G-P106W |
| 281 | T61E-T102I-P106A |
| 282 | V111N |
| 283 | V111Q |
| 284 | V160P |
| 285 | V297Q |
| 286 | V332K |
| 287 | V332Q |
| 288 | V43P |
| 289 | V43Q |
| 290 | V77N |
| 291 | V77N-T102G-P106S |
| 292 | V77N-T102G-P106W |
| 293 | V86C |
| 294 | V86C-T102G-P106S |
| 295 | V86C-T102G-P106W |
| 296 | Y54G |
| 297 | Y54G-T102G-P106W |
| 298 | N28Q-R60E-A71M-T102G-P106S-K203A-T269C-E378L |
| 299 | N28Q-R60K-T102G-P106S-E378L |
| 300 | N28T-R60E-A71M-P106I-L107S-K203A-T269C-E378L |
| 301 | N28T-R60E-A71M-T102G-A103C-P106W-G115S-K203A-T269C-E378L |
| 302 | N28T-R60E-A71M-T102G-A103V-P106S-L107V-K203A-T269C-E378L |
| 303 | N28T-R60E-A71M-T102G-P106S-K203A-T269C-E378L |
| 304 | N28T-R60E-P106I-L107S-E378L |
| 305 | N28T-R60E-T102G-A103C-P106W-G115S-E378L |
| 306 | N28T-R60E-T102G-A103V-P106S-L107V-E378L |
| 307 | N28T-R60E-T102G-P106S-E378L |
| 308 | N28T-R60E-T102G-P106S-K203A-E378L |
| 309 | N28T-R60K-A71M-T102G-P106S-E378L |
| 310 | N28T-R60K-A71M-T102G-P106S-K203A-T269C-E378L |
| 311 | N28T-R60K-T102G-P106S-E378L |
| 312 | N28T-R60K-T102G-P106S-T269C-E378L |
| 313 | R60E-P106I-L107S-E378L |
| 314 | R60E-T102G-A103C-P106W-G115S-E378L |
| 315 | R60E-T102G-A103V-P106S-L107V-E378L |
| 316 | R60E-T102G-P106S-E378L |
| 317 | R60K-T102G-P106S-E378L |
| 318 | Wild-type Maize EPSPS cDNA Sequence |
| 319 | Wild-type Maize EPSPS Genomic DNA Sequence |
| 320 | N28C |
| 321 | N28H |
| 322 | N28S |
| 323 | N28V |

TABLE 1-continued

Amino Acid Sequences of Recombinant or Engineered Maize EPSP synthases.

| SEQUENCE | VARIANT |
|---|---|
| 324 | L33E |
| 325 | G39K |
| 326 | N45G |
| 327 | L46C |
| 328 | L46W |
| 329 | L56E |
| 330 | L56K |
| 331 | R60Q |
| 332 | L62F |
| 333 | G63L |
| 334 | L64G |
| 335 | S65Q |
| 336 | S65R |
| 337 | K70L |
| 338 | K73P |
| 339 | G101A |
| 340 | G101E |
| 341 | T102G |
| 342 | T102L |
| 343 | T102Q |
| 344 | T102V |
| 345 | A103C |
| 346 | A103D |
| 347 | A103G |
| 348 | A103I |
| 349 | A103L |
| 350 | A103P |
| 351 | A103R |
| 352 | R105A |
| 353 | P106C |
| 354 | P106G |
| 355 | P106I |
| 356 | P106L |
| 357 | P106Q |
| 358 | P106S |
| 359 | P106T |
| 360 | P106V |
| 361 | P106W |
| 362 | L107A |
| 363 | L107C |
| 364 | L107F |
| 365 | L107G |
| 366 | L107K |
| 367 | L107M |
| 368 | L107Q |
| 369 | L107S |
| 370 | L107V |
| 371 | L107W |
| 372 | T112V |
| 373 | T112W |
| 374 | A114C |
| 375 | G115S |
| 376 | A118F |
| 377 | L122D |
| 378 | G124K |
| 379 | V125D |
| 380 | I133M |
| 381 | G144D |
| 382 | P190L |
| 383 | A192T |
| 384 | T278N |
| 385 | E288I |
| 386 | A333I |
| 387 | E379M |
| 388 | E379N |
| 389 | Y383E |
| 390 | P418G |
| 391 | A71M-T102G-A103V-P106L-L107V |
| 392 | T17M-A71M-T102G-A103V-P106S-L107V |
| 393 | N28H-T102G-P106S |
| 394 | N28Q-T102G-A103V-P106S-L107V |
| 395 | R60E-T102G-A103V-P106S-L107V-T278N-E378L |
| 396 | N28S-T102G-A103V-P106S-L107V |
| 397 | N28H-T102G-A103V-P106S-L107V |
| 398 | T102G-A103V-P106L-L107V-T269C |
| 399 | T17M-T102G-A103V-P106S-L107V-T269C |
| 400 | R60K-T102G-A103V-P106S-L107V-T269C-E378L |
| 401 | T17M-N28Q-R60K-T102G-A103V-P106S-L107V-E378L |
| 402 | T102G-A103V-P106S-L107V-T269C-T278N |
| 403 | T102G-A103R-P106C |
| 404 | S65K-A71M-T102G-A103V-P106S-L107V |
| 405 | T102G-P106S-V125D |
| 406 | R60K-T102G-P106S-E379N |
| 407 | A71M-T102G-A103V-P106S-L107V-E379N |
| 408 | A71M-T102G-A103V-P106S-L107V-V125D |
| 409 | T102G-A103C-P106W-G115S |
| 410 | T17M-N28Q-R60K-A71M-T102G-A103V-P106S-L107V-K203A-T269C-E378L |
| 411 | G101A-G144D |
| 412 | G101A-A192T |

In another embodiment, the invention provides an engineered protein comprising one or more amino acid substitution(s) described herein, and the recombinant DNA molecules encoding it, having at least about 85% sequence identity, about 90% sequence identity, about 91% sequence identity, about 92% sequence identity, about 93% sequence identity, about 94% sequence identity, about 95% sequence identity, about 96% sequence identity, about 97% sequence identity, about 98% sequence identity, about 99% sequence identity, about 99.5% sequence identity, about 99.8% sequence identity and about 99.9% sequence identity to SEQ ID NO:1.

Engineered proteins provided by the invention thus, in certain embodiments, provide an engineered EPSPS with one or more altered protein characteristics relative to a similar EPSPS, or wild-type EPSPS, found in nature. In one embodiment of the invention, such altered protein characteristics may include those that result in decreased sensitivity, or increased tolerance, to glyphosate or improved enzyme kinetics, as compared to a similar wild-type EPSPS, for instance an EPSPS comprising the sequence of SEQ ID NO:1.

Such EPSPS variants or engineered EPSP synthases that exhibit a decreased affinity for glyphosate while simultaneously maintaining the catalytic efficiency of the enzyme therefore provide a method of achieving glyphosate tolerance in crops. EPSPS variants or engineered EPSP synthases can be evaluated by measuring the enzyme's maximal velocity ($V_{max}$), representing how fast the enzyme can catalyze the reaction under substrate saturation conditions, and the Michaelis-Menten Constant ($K_m$), representing the substrate concentration at half the enzyme's catalytic capacity. The high proportion of carbon flux through the shikimate pathway requires a highly efficient EPSPS (maximum catalytic efficiency) to prevent metabolic limitations or bottlenecks as required by a wide variety of growth conditions in various developmental stages.

As used herein, the term "recombinant" refers to a non-naturally occurring DNA, protein, cell, seed, or organism that is the result of genetic engineering or genome editing and as such would not normally be found in nature and was created by human intervention. A "recombinant DNA molecule" is a DNA molecule comprising a DNA sequence that is the result of human intervention, for example, a DNA molecule that is engineered or a DNA molecule that encodes an engineered protein or engineered enzyme. Another example is a DNA molecule comprised of a combination of at least two DNA molecules heterologous to each other, such as a protein-coding DNA molecule and an operably linked heterologous promoter. Another example is a DNA molecule encoding an EPSPS protein comprising any one or more of the amino acid substitutions described herein. A "recombinant protein" is a protein comprising an amino acid sequence that is the result of human intervention, for example, an engineered protein. A recombinant cell, seed, or organism is a cell, seed, or organism comprising a modified genome, created as a result of the use of genome editing techniques or the use of plant transformation techniques, for example a plant cell, seed, plant, or plant part comprising a DNA molecule or protein of the invention.

As used herein, "wild-type" means a naturally occurring or typically occurring form. A "wild-type DNA molecule" or "wild-type protein" is the version of a DNA molecule or protein that is naturally or typically occurring. For crop plants, this would be the version of a DNA molecule or protein that is typically found in that crop. The DNA sequence or amino acid sequence of the wild-type DNA molecule or protein is the sequence that typically exists in that crop. A wild-type version of a DNA molecule or protein may be useful as a reference DNA molecule or reference protein for comparison with a recombinant or engineered DNA molecule or protein. An example of a wild-type protein useful for comparison with the engineered proteins provided by the invention is the EPSPS from maize provided as SEQ ID NO:1. Other wild-type EPSP synthases useful for comparison with the engineered proteins provided by the invention are known from other plants.

A "wild-type plant" is a naturally occurring plant. Such wild-type plants may also be useful for comparison with a plant comprising a recombinant or engineered DNA molecule or protein. An example of a wild-type plant useful for comparison with plants comprising a recombinant or engineered DNA molecule or protein may be a plant of the same type as the plant comprising the engineered DNA molecule or protein, such as a protein conferring an herbicide tolerance trait, and as such is genetically distinct from the plant comprising the herbicide tolerance trait. An example of a wild-type plant useful for comparison for maize plants includes glyphosate-sensitive LH244 maize (ATCC deposit number PTA-1173, ATCC®, Manassas, Va. USA).

In certain embodiments, wild-type plants may also be used or referred to as "control plants." As used herein, "control" means an experimental control designed for comparison purposes. For example, a control plant is a plant of the same type as the experimental plant (that is, the plant to be tested) but does not contain the transgenic insert, recombinant DNA molecule, or genome modification of the experimental plant.

As used herein, the term "DNA" or "DNA molecule" refers to a double-stranded DNA molecule of genomic or synthetic origin (that is, a polymer of deoxyribonucleotide bases or a polynucleotide molecule) read from the 5' (upstream) end to the 3' (downstream) end. As used herein, the term "DNA sequence" refers to the nucleotide sequence of a DNA molecule. The nomenclature used herein corresponds to that of by Title 37 of the United States Code of Federal Regulations § 1.822, and set forth in the tables in WIPO Standard ST.25 (1998), Appendix 2, Tables 1 and 3.

The present disclosure provides a nucleic acid molecule encoding a maize EPSPS having one or more amino acid substitution(s) chosen from I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102I, T102L, T102Q, T102V, A103C, A103D, A103F, A103G, A103I, A103L, A103P, A103R, A103V, R105A, P106A, P106C, P106G, P106I, P106L, P106Q, P106S, P106T, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, and combinations thereof, wherein the position of the amino acid substitution(s) is relative to the amino acid position set forth in SEQ ID NO:1.

As used herein, the term "protein-coding DNA molecule" refers to a DNA molecule comprising a DNA sequence that encodes a protein. A DNA sequence that encodes a protein (also known as a "protein-coding sequence") is composed of a series of three-nucleotide sequences called codons, which serve as the genetic information that is used to produce the amino acid sequence of protein. As used herein, the term "protein" refers to a chain of amino acids linked by peptide (amide) bonds and includes both polypeptide chains that are folded or arranged in a biologically functional way and polypeptide chains that are not. As used herein, a "sequence" means a sequential arrangement of nucleotides or amino acids. The boundaries of a protein-coding sequence are usually determined by a translation start codon at the 5'-terminus and a translation stop codon at the 3'-terminus.

As used herein, the term "isolated" refers to at least partially separating a molecule from other molecules typically associated with it in its natural state. In one embodiment, the term "isolated" refers to a DNA molecule that is separated from the nucleic acids that normally flank the DNA molecule in its natural state. For example, a DNA molecule encoding a protein that is naturally present in a bacterium would be an isolated DNA molecule if it was not within the DNA of the bacterium from which the DNA molecule encoding the protein is naturally found. Thus, a DNA molecule fused to or operably linked to one or more other DNA molecule(s) with which it would not be associated in nature, for example as the result of recombinant DNA or plant transformation techniques, is considered isolated herein. Such molecules are considered isolated even when integrated into the chromosome of a host cell or present in a nucleic acid solution with other DNA molecules.

Any number of methods well known to those skilled in the art can be used to isolate and manipulate a DNA molecule, or fragment thereof, as disclosed herein. For example, polymerase chain reaction (PCR) technology can be used to amplify a particular starting DNA molecule and/or to produce variants of the original molecule. DNA molecules, or fragment thereof, can also be obtained by other techniques, such as by directly synthesizing the fragment by chemical means, as is commonly practiced by using an automated oligonucleotide synthesizer.

Because of the degeneracy of the genetic code, a different DNA sequences can encode the same amino acid sequence. For example, FIG. 2 provides the universal genetic code chart showing all possible mRNA triplet codons (where T in the DNA molecule is replaced by U in the RNA molecule) and the amino acid encoded by each codon. DNA sequences encoding EPSPS with the amino acid substitutions described herein can be produced by introducing changes or mutations into the DNA sequence encoding wild-type EPSPS using methods known in the art and the information provided in FIG. 2. It is well within the capability of one of skill in the art to create alternative DNA sequences encoding the same, or essentially the same, altered or engineered proteins as described herein. These variant or alternative DNA sequences are within the scope of the embodiments described herein. As used herein, references to "essentially the same" sequence refers to sequences which encode amino acid substitutions, deletions, additions, or insertions that do not materially alter the functional activity of the protein encoded by the DNA molecule of the embodiments described herein. Allelic variants of the nucleotide sequences encoding a wild-type or engineered protein are also encompassed within the scope of the embodiments described herein. Substitution of amino acids other than those specifically exemplified or naturally present in a wild-type or engineered EPSPS are also contemplated within the scope of the embodiments described herein, so long as the EPSPS having the substitution still retains substantially the same functional activity described herein.

As used herein, the term "percent sequence identity" or "% sequence identity" refers to the percentage of identical nucleotides or amino acids in a linear polynucleotide or amino acid sequence of a reference ("query") sequence (or its complementary strand) as compared to a test ("subject") sequence (or its complementary strand) when the two sequences are optimally aligned (with appropriate nucleotide or amino acid insertions, deletions, or gaps totaling less than 20 percent of the reference sequence over the window of comparison). Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and by computerized implementations of these algorithms such as GAP, BESTFIT, FASTA, and TFASTA available as part of the Sequence Analysis software package of the GCG® Wisconsin Package® (Accelrys Inc., San Diego, Calif.), MEGAlign (DNAStar Inc., 1228 S. Park St., Madison, Wis. 53715), and MUSCLE (version 3.6) (R C Edgar, "MUSCLE: multiple sequence alignment with high accuracy and high throughput" *Nucleic Acids Research* 32(5): 1792-7 (2004)) for instance with default parameters. An "identity fraction" for aligned segments of a test sequence and a reference sequence is the number of identical components that are shared by the two aligned sequences divided by the total number of components in the portion of the reference sequence segment being aligned, that is, the entire reference sequence or a smaller defined part of the reference sequence. Percent sequence identity is represented as the identity fraction multiplied by 100. The comparison of one or more sequences may be to a full-length sequence or a portion thereof, or to a longer sequence.

As used herein, a "DNA construct" is a recombinant DNA molecule comprising two or more heterologous DNA sequences. DNA constructs are useful for transgene expression and may be comprised in vectors and plasmids. DNA constructs may be used in vectors for transformation, that is the introduction of heterologous DNA into a host cell, to produce transgenic plants and cells, and as such may also be contained in the plastid DNA or genomic DNA of a transgenic plant, seed, cell, or plant part. As used herein, a "vector" means any recombinant DNA molecule that may be used for the purpose of bacterial or plant transformation.

DNA molecules provided herein can, for example, be inserted into a vector as part of a construct having the DNA molecule operably linked to a gene expression element that functions in a plant to affect expression of the protein encoded by the DNA molecule. Methods for constructing DNA constructs and vectors are well known in the art and described in detail in, for example, handbooks and laboratory manuals including M. R. Green and J. Sambrook, "Molecular Cloning: A Laboratory Manual" (Fourth Edition) ISBN:978-1-936113-42-2, Cold Spring Harbor Laboratory Press, N.Y. (2012). The components for a DNA construct, or a vector comprising a DNA construct, include one or more gene expression elements operably linked to a transcribable DNA sequence, such as the following: a promoter for the expression of an operably linked DNA, an operably linked protein-coding DNA molecule, and an operably linked 3' untranslated region (UTR). Gene expression elements useful in practicing the present invention include, but are not limited to, one or more of the following type of elements: promoter, 5' UTR, enhancer, leader, cis-acting element, intron, targeting sequence, 3' UTR, and one or more selectable marker transgenes.

The term "transgene" refers to a DNA molecule artificially incorporated into the genome of an organism as a result of human intervention, such as by plant transformation methods. As used herein, the term "transgenic" means comprising a transgene, for example a "transgenic plant" refers to a plant comprising a transgene in its genome and a "transgenic trait" refers to a characteristic or phenotype conveyed or conferred by the presence of a transgene incorporated into the plant genome. As a result, the transgenic plant is something distinctly different from the related wild-type plant and the transgenic trait is a trait not naturally found in the wild-type plant. Transgenic plants of the invention comprise the recombinant DNA molecules and engineered proteins provided by the invention.

As used herein, the term "heterologous" refers to the relationship between two or more things not normally associated in nature, for instance that are derived from different sources or not normally found in nature together in any other manner. For example, a DNA molecule or protein may be heterologous with respect to another DNA molecule, protein, cell, plant, seed, or organism if not normally found in nature together or in the same context. In certain embodiments, a first DNA molecule is heterologous to a second DNA molecule if the two DNA molecules are not normally found in nature together in the same context. For instance, a protein-coding recombinant DNA molecule is heterologous with respect to an operably linked promoter if such a combination is not normally found in nature. Similarly, a protein is heterologous with respect to a second operably linked protein, such as a transit peptide, if such combination is not normally found in nature. In another embodiment, a recombinant DNA molecule encoding an EPSPS is heterologous with respect to an operably linked promoter that is functional in a plant cell if such combination is not normally found in nature. A recombinant DNA molecule also may be heterologous with respect to a cell, seed, or organism into which it is inserted when it would not naturally occur in that cell, seed, or organism.

A "heterologous protein" is a protein present in a plant, seed, cell, tissue, or organism in which it does not naturally occur or operably linked to a protein with which it is not naturally linked. An example of a heterologous protein is an engineered EPSPS protein comprising at least a first amino acid substitution described herein that is expressed in any plant, seed, cell, tissue, or organism. Another example is a protein operably linked to a second protein, such as a transit peptide or herbicide-tolerant protein, with which it is not naturally linked, or a protein introduced into a plant cell in which it does not naturally occur using the techniques of genetic engineering.

As used herein, "operably linked" means two or more DNA molecules or two or more proteins linked in manner so that one may affect the function of the other. Operably-linked DNA molecules or operably-linked proteins may be part of a single contiguous molecule and may or may not be adjacent. For example, a promoter is operably linked with a protein-coding DNA molecule in a DNA construct where the two DNA molecules are so arranged that the promoter may affect the expression of the transgene.

The DNA constructs of the invention may include a promoter operably linked to a protein-coding DNA molecule provided by the invention, whereby the promoter drives expression of the recombinant protein molecule. Promoters useful in practicing the present invention include those that function in a cell for expression of an operably linked polynucleotide, such as a bacterial or plant promoter. Plant promoters are varied and well known in the art and include, for instance, those that are inducible, viral, synthetic, constitutive, temporally regulated, spatially regulated, and/or spatio-temporally regulated.

In one embodiment of the invention, a DNA construct provided herein includes a DNA sequence encoding a targeting sequence that is operably linked to a heterologous DNA sequence encoding a maize EPSPS, whereby the targeting sequence facilitates localizing the polypeptide molecule within the cell. Targeting sequences are known in the art as signal sequences, targeting peptides, localization sequences, and transit peptides. An example of a targeting sequence is a chloroplast transit peptide (CTP), a mitochondrial targeting sequence (MTS), or a dual chloroplast and mitochondrial targeting peptide. By facilitating protein localization within the cell, the targeting sequence may increase the accumulation of recombinant protein, protect the protein from proteolytic degradation, and/or enhance the level of herbicide tolerance, and thereby reduce levels of injury in the cell, seed, or organism after herbicide application. CTPs and other targeting molecules that may be used in connection with the present invention are well known in the art.

As used herein, "expression", "expressing", "protein expression", and "expressing a protein" mean the production of a protein through the process of transcribing a DNA molecule into messenger RNA (mRNA) and translating the mRNA into polypeptide chains, which are ultimately folded into proteins. A protein-coding DNA molecule may be operably linked to a heterologous promoter in a DNA construct for use in expressing the protein in a cell transformed with the recombinant DNA molecule.

In one aspect the invention provides cells, tissues, plants, and seeds comprising the recombinant DNA molecules or expressing the engineered proteins, such as the engineered EPSP synthases, of the present invention. These cells, tissues, plants, and seeds comprising the recombinant DNA molecules or engineered proteins exhibit tolerance to glyphosate.

One method of producing such cells, tissues, plants, and seeds is through plant transformation. Suitable methods for transformation of host plant cells for use with the current invention include any method by which DNA can be introduced into a cell (for example, where a recombinant DNA construct is stably integrated into a plant chromosome) and are well known in the art. Two effective, and widely utilized, methods for cell transformation are *Agrobacterium*-mediated transformation and microprojectile bombardment-mediated transformation. Microprojectile bombardment methods are illustrated, for example, in U.S. Pat. Nos. 5,550,318; 5,538,880; 6,160,208; and 6,399,861. *Agrobacterium*-mediated transformation methods are described, for example in U.S. Pat. No. 5,591,616, which is incorporated herein by reference in its entirety.

Another method of producing such cells, tissues, plants, and seeds is through genome editing. As used herein, the term "genome editing" refers to the use of genome editing methods and a site-specific genome modification enzyme to modify a nucleotide sequence. Suitable methods for altering a wild-type DNA sequence at a pre-determined chromosomal site include any method known in the art. Exemplary methods include the use of sequence specific nucleases, such as zinc-finger nucleases, engineered or native meganucleases, TALE-endonucleases, or an RNA-guided endonucleases (for example, a Clustered Regularly Interspersed Short Palindromic Repeat (CRISPR)/Cas9 system, a CRISPR/Cpf1 system, a CRISPR/CasX system, a CRISPR/CasY system, a CRISPR/Cascade system). Several embodiments relate to methods of genome editing by using single-stranded oligonucleotides to introduce precise base pair modifications in a plant genome, as described by Sauer et al., *Plant Physiology* 170(4):1917-1928 (2016). Methods of genome editing to modify, delete, or insert nucleic acid sequences into genomic DNA are known in the art.

Several embodiments relate to a plant comprising in its genome a modified EPSPS coding sequence, wherein the modified EPSPS coding sequence encodes a glyphosate-tolerant EPSPS as described herein. In certain embodiments, genome editing methods are utilized for the modification or replacement of an existing coding sequence, such as an EPSPS coding sequence, within a plant genome with a sequence encoding an engineered protein, such as an engineered EPSPS coding sequence of the present invention. In some embodiments, the native EPSPS coding sequence is modified to comprise one or more targeted nucleotide changes, additions, deletions, or other modifications, such that the modified EPSPS coding sequence encodes a glyphosate-tolerant EPSPS that comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E5 OF-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-

P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-1269C-E378L, G101A-G144D, and G101A-A192T.

Several embodiments relate to the use of known genome editing methods, and a site-specific genome modification enzyme, such as zinc-finger nucleases, engineered or native meganucleases, TALE-endonucleases, or an RNA-guided endonucleases (for example, a Clustered Regularly Interspersed Short Palindromic Repeat (CRISPR)/Cas9 system, a CRISPR/Cpf1 system, a CRISPR/CasX system, a CRISPR/CasY system, a CRISPR/Cascade system) to modify or replace an existing EPSPS coding sequence in the genome of a plant. Several embodiments therefore relate to providing a site-specific genome modification enzyme capable of recognizing a specific nucleotide sequence of interest, such as a maize EPSPS sequence, within a genome of a plant to allow for alteration of the EPSPS sequence by non-templated editing or by templated editing.

Several embodiments relate to a recombinant DNA construct comprising an expression cassette(s) encoding a site-specific nuclease and/or any associated protein(s) to carry out genome modification. These nuclease-expressing cassette(s) may be present in the same molecule or vector as a donor template for templated editing wherein the donor template encodes a glyphosate-tolerant maize EPSPS protein as described herein in cis or on a separate molecule or vector (in trans). Several methods for templated editing are known in the art involving different sequence-specific nucleases (or complexes of proteins and/or guide RNA) that cut the genomic DNA to produce a double strand break (DSB) or nick at a desired genomic site or locus. As understood in the art, during the process of repairing the DSB or nick introduced by the nuclease enzyme, the donor template DNA may become integrated into the genome at the site of the DSB or nick.

As used herein, the term "site-specific genome modification enzyme" refers to any enzyme that can modify a nucleotide sequence in a sequence-specific manner. In some embodiments, a site-specific genome modification enzyme modifies the genome by inducing a single-strand break. In some embodiments, a site-specific genome modification enzyme modifies the genome by inducing a double-strand break. In some embodiments, a site-specific genome modification enzyme comprises a cytidine deaminase. In some embodiments, a site-specific genome modification enzyme comprises an adenine deaminase. In the present disclosure, site-specific genome modification enzymes include endonucleases, recombinases, transposases, deaminases, helicases and any combination thereof. In some embodiments, the site-specific genome modification enzyme is a sequence-specific nuclease.

In one aspect, the site-specific genome modification enzyme comprises an endonuclease selected from a meganuclease, a zinc-finger nuclease (ZFN), a transcription activator-like effector nucleases (TALEN), an Argonaute (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), an RNA-guided nuclease, such as a CRISPR associated nuclease (non-limiting examples of CRISPR associated nucleases include Cas1, Cas1B, Cas2, Cas3, Cas4, Cas5, Cas6, Cas7, Cas8, Cas9 (also known as Csn1 and Csx12), Cas10, Cas12a (also known as Cpf1), Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, CasX, CasY, homologs thereof, or modified versions thereof).

In some embodiments, the site-specific genome modification enzyme comprises a DNA binding domain operably linked to a deaminase. In some embodiments, the site-specific genome modification enzyme further comprises uracil DNA glycosylase (UGI). In some embodiments, the deaminase is a cytidine deaminase. In some embodiments, the deaminase is an adenine deaminase. In some embodiments, the deaminase is an APOBEC deaminase. In some embodiments, the deaminase is an activation-induced cytidine deaminase (AID). In some embodiments, the DNA binding domain is a zinc-finger DNA-binding domain, a TALE DNA-binding domain, a Cas9 nuclease, a Cas12a nuclease, a catalytically inactive Cas9 nuclease, a catalytically inactive Cas12a nuclease, a Cas9 nickase, or a Cpf1 nickase.

In some embodiments, the site-specific genome modification enzyme is a recombinase. Non-limiting examples of recombinases include a tyrosine recombinase attached to a DNA recognition motif provided herein is selected from the group consisting of a Cre recombinase, a Gin recombinase, a Flp recombinase, and a Tnp1 recombinase. In an aspect, a Cre recombinase or a Gin recombinase provided herein is tethered to a zinc-finger DNA-binding domain, or a TALE DNA-binding domain, or a Cas9 nuclease. In another aspect, a serine recombinase attached to a DNA recognition motif provided herein is selected from the group consisting of a PhiC31 integrase, an R4 integrase, and a TP-901 integrase. In another aspect, a DNA transposase attached to a DNA binding domain provided herein is selected from the group consisting of a TALE-piggyBac and TALE-Mutator.

In one aspect, the invention provides cells, plants, and seeds that are tolerant to glyphosate. Such cells, plants, and seeds are useful in the methods of agriculture, such as weed control and crop production.

As used herein, "herbicide" is any molecule that is used to control, prevent, or interfere with the growth of one or more plants. Exemplary herbicides include 5-enolpyruvyl-shikimate-3-phosphate synthase (EPSPS) inhibitors (for example glyphosate), acetyl-CoA carboxylase (ACCase) inhibitors (for example aryloxyphenoxy propionates and cyclohexanediones), acetolactate synthase (ALS) inhibitors (for example sulfonylureas, imidazolinones, triazolopyrimidines, and triazolinones), synthetic auxins (for example phenoxys, benzoic acids, carboxylic acids, semicarbazones), photosynthesis (photosystem II) inhibitors (for example triazines, triazinones, nitriles, benzothiadiazoles, and ureas), glutamine synthetase (GS) inhibitors (for example glufosinate and bialaphos), 4-hydroxyphenylpyruvate dioxygenase (HPPD) inhibitors (for example isoxazoles, pyrazolones, and triketones), protoporphyrinogen oxidase (PPO) inhibitors (for example diphenylethers, N-phenylphthalimide, aryl triazinones, and pyrimidinediones), very long-chain fatty acid inhibitors (for example chloroacetamides, oxyacetamides, and pyrazoles), cellulose biosynthesis inhibitors (for example indaziflam), photosystem I inhibitors (for example paraquat), microtubule assembly inhibitors (for example pendimethalin), and phytoene desaturase (PDS) inhibitors (for example norflurazone), among others.

As used herein, "glyphosate tolerance" or "glyphosate-tolerant" with respect to a protein means the ability to maintain at least some of its activity or function in the presence of glyphosate. For example, an EPSPS is glyphosate-tolerant if it maintains at least some of its enzymatic activity in the presence of glyphosate. Glyphosate tolerance can be measured by any means known in the art. For example, the enzymatic activity of an EPSPS can be measured by a bacterial assay, such as the growth assays described herein, whereby a recombinant EPSPS is expressed in a bacterial cell otherwise lacking EPSPS activity and the ability of the recombinant EPSPS to complement this knockout phenotype is measured. In another example, enzymatic activity of an EPSPS can be measured by analyzing enzyme kinetics in the presence and absence of glyphosate. Glyphosate tolerance may be complete or partial insensitivity to glyphosate.

As used herein, "glyphosate tolerance" or "glyphosate-tolerant" with respect to an organism, plant, seed, tissue, part, or cell means the organism, plant, seed, tissue, part, or cell's ability to resist the toxic effects of glyphosate when applied. For example, a glyphosate-tolerant plant can survive or continue to grow in the presence of glyphosate. The glyphosate tolerance of a plant, seed, plant tissue, plant part, or cell may be measured by comparing the plant, seed, plant tissue, plant part, or cell to a suitable control. For example, the glyphosate tolerance may be measured by applying glyphosate to a plant comprising a recombinant DNA molecule encoding a modified EPSPS capable of conferring glyphosate tolerance (the test plant) and a plant not comprising the recombinant DNA molecule encoding the modified EPSPS capable of conferring glyphosate tolerance (the control plant) and subsequently comparing the injury rates of the two plants. Glyphosate tolerance of the test plant is indicated by a decreased injury rate when compared to the injury rate of the control plant. A glyphosate-tolerant plant, seed, plant tissue, plant part, or cell exhibits a decreased response to the toxic effects of glyphosate when compared to a control plant, seed, plant tissue, plant part, or cell.

As used herein, a "glyphosate tolerance trait" is a trait imparting improved glyphosate tolerance to a plant as compared to the wild-type plant. Contemplated plants that may be produced with the glyphosate tolerance trait of the present invention could include, for instance, any plant including monocot and dicot crop plants, among others. Examples of monocot crop plants that may be produced with the glyphosate tolerance trait of the present invention include, but are not limited to, *Zea mays, Sorghum bicolor, Triticum aestivum, Secale cereale, Musa paradisiaca* L., *Musa sapientum* L., *Allium sativum, Allium ampeloprasum, Allium cepa* L., *Oryza sativa, Asparagus officinalis, Avena sativa* L., and *Hordeum vulgare*. Examples of dicot crop plants that may be produced with the glyphosate tolerance trait of the present invention include, but are not limited to, *Glycine max, Gossypium hirsutum, Goyssypium barbadense, Brassica napus*, and *Brassica rapa*.

A maize plant, as referenced herein, refers to any plant selected from the genus *Zea*, including, but not limited to, any plant selected from the species *Zea mays* L.

As used herein, a "weed" is any undesired plant. A plant may be considered generally undesirable for agriculture or horticulture purposes (for example, *Amaranthus* species) or may be considered undesirable in a particular situation (for example, a crop plant of one species in a field of a different species, also known as a volunteer plant). Weeds are commonly known in the art and vary by geography, season, growing environment, and time. Lists of weed species are available from agricultural and scientific societies (such as the Weed Science Society of America and the Canadian Weed Science Society), government agencies (such as the United States Department of Agriculture and the Australia Department of the Environment and Energy), and industry and farmer associations (such as the United Soybean Board, the National Corn Growers Association, and the Canola Council of Canada).

The herbicide application may be the recommended commercial rate (1×) or any fraction or multiple thereof, such as twice the recommended commercial rate (2×). In certain embodiment, herbicide rates may be expressed as grams per hectare (g/h) or pounds per acre (lbs/acre), acid equivalent per pound per acre (lb ae/acre), acid equivalent per gram per hectare (g ae/ha), pounds active ingredient per acre (lb ai/acre), or grams active ingredient per hectare (g ai/ha) depending on the herbicide and the formulation. The plant growth area may or may not comprise weed plants at the time of herbicide application. An herbicidally-effective dose of glyphosate for use in an area for controlling weeds should consist of a range from about 0.1× to about 3× label rate(s) over a growing season. One (1) acre is equivalent to 2.47105 hectares and one (1) pound is equivalent to 453.592 grams. Herbicide rates can be converted between English and metric as: (lb ai/ac) multiplied by 1.12=(kg ai/ha) and (kg ai/ha) multiplied by 0.89=(lb ai/ac).

Herbicide applications may be sequentially or tank mixed with one, two, or a combination of several herbicides or any other compatible herbicide. Multiple applications of one herbicide or of two or more herbicides, in combination or alone, may be used over a growing season to areas comprising plants of the invention for the control of a broad spectrum of dicot weeds, monocot weeds, or both, for example, two applications (such as a pre-planting application and a post-emergence application or a pre-emergence application and a post-emergence application) or three applications (such as a pre-planting application, a pre-emergence application, and a post-emergence application or a pre-emergence application and two post-emergence applications).

Accordingly, the current disclosure provides methods for selectively controlling weeds in a field containing a crop that involve planting the field with crop seeds or plants which are glyphosate tolerant as a result of being transformed with a recombinant DNA molecule encoding an EPSPS disclosed herein or an active variant or fragment thereof, and applying to the crop and weeds in the field a sufficient amount of glyphosate to control the weeds without significantly affecting the crop.

The plants, progeny, seeds, plant cells, and plant parts of the invention may also contain one or more additional traits. Additional traits may be introduced by crossing a plant comprising the recombinant DNA molecules provided by the invention with another plant containing one or more additional trait(s). As used herein, "crossing" means breeding two individual plants to produce a progeny plant. Two plants may be crossed to produce progeny that contain the desirable traits from each parent. As used herein "progeny" means the offspring of any generation of a parent plant, and progeny comprise an herbicide-tolerance trait provided by the invention and inherited from at least one parent plant. Additional trait(s) also may be introduced by any means known in the art. Such additional traits include, but are not limited to, increased insect resistance, increased water use efficiency, increased yield performance, increased drought resistance, increased seed quality, improved nutritional quality, hybrid seed production, and herbicide-tolerance, in which the trait is measured with respect to a wild-type plant. Exemplary additional herbicide tolerance traits may include transgenic or non-transgenic tolerance to one or more herbicides such as ACCase inhibitors (for example, aryloxyphenoxy propionates and cyclohexanediones), ALS inhibitors (for example, sulfonylureas, imidazolinones, triazolopyrimidines, and triazolinones) EPSPS inhibitors (for example, glyphosate), synthetic auxins (for example, phenoxys, benzoic acids, carboxylic acids, semicarbazones), photosynthesis inhibitors (for example, triazines, triazinones, nitriles, benzothiadiazoles, and ureas), glutamine synthesis inhibitors (for example, glufosinate), HPPD inhibitors (for example, isoxazoles, pyrazolones, and triketones), PPO inhibitors (for example, diphenylethers, N-phenylphthalimide, aryl triazinones, and pyrimidinediones), and long-chain fatty acid inhibitors (for example, chloroacetamindes, oxyacetamides, and pyrazoles), among others. Exemplary insect resistance traits may include resistance to one or more insect members within one or more of the orders of Lepidoptera, Coleoptera, Hemiptera, Thysanoptera, Diptera, Hymenoptera, and Orthoptera, among others. Such additional traits are well-known to one of skill in the art; for example, and a list of such transgenic traits is provided by the United States Department of Agriculture's (USDA) Animal and Plant Health Inspection Service (APHIS).

Plants and progeny that are glyphosate tolerant may be used with any breeding methods that are commonly known in the art. In plant lines comprising two or more traits, the traits may be independently segregating, linked, or a combination of both in plant lines comprising three or more traits. Backcrossing to a parental plant and outcrossing with a non-traited plant are also contemplated, as is vegetative propagation. Descriptions of breeding methods that are commonly used for different traits and crops are well-known to those of skill in the art. To confirm the presence of the transgene(s) or a genome modification in a plant or seed, a variety of assays may be performed. Such assays include, for example, molecular biology assays, such as Southern and northern blotting, PCR, and DNA sequencing; biochemical assays, such as detecting the presence of a protein product, for example, by immunological means (ELISAs and western blots) or by enzymatic function; plant part assays, such as leaf or root assays; and, by analyzing the phenotype of the whole plant.

Introgression of a trait into a plant genotype is achieved as the result of the process of backcross conversion. A plant genotype into which a trait has been introgressed may be referred to as a backcross converted genotype, line, inbred, or hybrid. Similarly, a plant genotype lacking the desired trait may be referred to as an unconverted genotype, line, inbred, or hybrid.

As used herein, the term "comprising" means "including but not limited to".

Having described several embodiments in detail, it will be apparent that modifications, variations, and equivalent embodiments are possible. Furthermore, it should be appreciated that the examples in the present disclosure are provided as non-limiting examples.

EXAMPLES

Example 1: Development and Characterization of T102X-P106X Maize EPSPS Variants

Collections of variant maize EPSPS coding sequences were created using methods known in the art and used to produce recombinant proteins to identify mutations in the enzyme that reduce sensitivity to glyphosate. A library of positional variants was produced by mutating the codons at amino acid positions 101, 102, and 106 (relative to the wild-type maize EPSPS provided as SEQ ID NO:1) using PCR site-directed mutagenesis. Two complementary primers were synthesized containing a degenerate mixture of the four bases at the three positions of the three codons. These primers were added to a starting plasmid template and thermal cycled to produce mutant DNA molecules, which were subsequently cloned into plasmids for bacterial transformation and recombinant protein expression. A collection of 8,000 EPSPS variants representing all possible amino acids at positions 101, 102, and 106 (G101X-T102X-P106X) was produced. These variant enzymes were characterized using bacterial and enzymatic assays.

A bacterial growth assay was performed to identify EPSPS variants that conferred glyphosate tolerance. An aroA-defective E. coli strain is unable to grow in minimal growth medium containing glyphosate due to its inability to produce EPSPS, which is encoded by the aroA gene. EPSPS activity can be restored in aroA-defective E. coli by transforming the cells with a EPSPS gene that confers glyphosate tolerance. Growth of these cells in minimal growth medium containing glyphosate demonstrates EPSPS proteins that confer glyphosate tolerance.

Plasmids comprising the coding sequences for the EPSPS variants were transformed into an aroA-defective strain of E. coli and evaluated for growth in minimal M9 liquid medium containing varying concentrations of glyphosate. The following double-mutant EPSPS variants were identified as conferring glyphosate tolerance: T102G-P106S; T102G-P106W; T102I-P106A; T102I-P106S; T102I-P106T; T102L-P106V; and T102V-P106S (positions relative to SEQ ID NO:1).

The seven double-mutant EPSPS variants identified as conferring glyphosate tolerance above were expressed in bacteria as N-His-tagged (TVMV cleavable) proteins in order to obtain purified recombinant protein to use in enzyme kinetics assays. Frozen bacterial cell pellets from 500 mL cell culture were resuspended in a volume of lysis buffer (50 mM NaP at pH 7.0, 50 mM NaCl, 10% (v/v) glycerol, 5 mM imidazole, 2 mM MgCl2, 0.25×YPER (Yeast Protein Extraction Reagent, Thermofisher), 0.75× BPER (Bacterial Protein Extraction Reagent, Thermofisher), 1 mg/mL lysozyme, 0.1 mM 4-(2-Aminoethyl) benzenesulfonyl fluoride hydrochloride (AEBSF), 150 U/mL benzonase, 1 mM benzamidine, and 1× dissolved Roche protease inhibitor tablet) that was four times (4×) the weight of the pellet. The solution was stirred for 30 minutes at room temperature. NaCl was added to the solution at 500 mM and the suspension was centrifuged for 30 minutes at 30,000×g. The resulting supernatant was added to 2 mL of Ni-NTA resin slurry (Qiagen), preequilibrated with $H_2O$, followed by IMAC wash buffer containing 50 mM sodium phosphate, 250 mM NaCl, 1% glycerol, and 5 mM imidazole. The resin was used to batch bind the cell pellet solubilization supernatants for 1 hour with stirring at 4° C., which were transferred to a 20 mL Bio-Rad disposable column and washed 3 times with 20 mL of IMAC wash buffer for 10 minutes each with stirring. The EPSPS protein was sequentially eluted with into six 1 mL fractions using IMAC wash buffer with 500 mM imidazole. Fractions containing significant protein were pooled and dialyzed overnight against 25 mM Tris (pH=8), 250 mM NaCl, 0.5% glycerol.

Purified recombinant protein was used to measure enzymatic activity in a variation of the assay described in Vazquez, M. J., B. Rodriguez, C. Zapatero and D. G. Tew, ("Determination of phosphate in nanomolar range by an enzyme-coupling fluorescent method", *Analytical Biochemistry* 320:292-298 (2003)). EPSPS enzymatic activity was measured in a solution consisting of 50 mM MOPS-KOH, pH 7.2, 0.5 mM $MgCl_2$, 15% (v/v) glycerol, 1.5 mM inosine, 0.05 mM Amplex Red, 0.2 U/mL, nucleoside phosphorylase, 0.4 U/mL xanthine oxidase, 1.0 U/mL horseradish peroxidase, and variable amounts of phosphoenolpyruvate (PEP), shikimate 3-phosphate (S3P), and glyphosate. The assay was performed in a 96-well plate with a final volume of 50 μL using the Mosquito® HV liquid handler (TTP Labtech Ltd.) for pipetting. For kinetic determinations, a master mix of all the non-variable components was created. Purified recombinant protein, glyphosate, PEP, and S3P were then added to the master mix as required. Enzyme kinetic measurements for $K_m$ and $V_{max}$ (with PEP S3P, or both) and $IC_{50}$ (also known as $I_{0.5}$) (with glyphosate) were analyzed by producing a Michaelis-Menten (for $K_m$ and $V_{max}$) or logarithmic scale (for $IC_{50}$) plot in GraphPad Prism 7.0 (GraphPad Software, Inc., La Jolla, Calif.) using the average values of three concentrations of each enzyme variant (normalized to a single enzyme concentration). Fluorescence change over time during the linear portion of the assay was determined on a Safire²™ (Tecan Trading AG, Switzerland). The fluorescence parameters were 555 nm for excitation and 590 nm for emission (5 nm band widths in both cases) and a manual gain of 100. Michaelis-Menten constants in the presence of PEP and S3P for each EPSPS variant were determined at saturating concentration (200 μM) of the substrate not being measured. $I_{0.5}$ in the presence of glyphosate was determined at S3P saturating concentration and PEP sub-saturating concentration (80 µM).

The seven double-mutant EPSPS variants were compared with wild-type maize EPSPS (SEQ ID NO:1) and *Agrobacterium tumefaciens* strain CP4 EPSPS. Data for $V_{max}$ (µmol/min/mg), $k_{cat}$ ($s^{-1}$), $K_m$ PEP (µM), $K_m$ S3P (µM), and $IC_{50}$ (mM) with standard error (SE) are provided in Table 2 (N.D. is Not Determined). All seven EPSPS variants, and CP4 EPSPS provided tolerance to glyphosate in the bacterial growth assay, but the enzymatic characteristics of these eight EPSPS varied considerably in the enzyme kinetics assay. For example, the variants T102I-P106A, T102I-P106S, T102I-P106T, and T102L-P106V had $k_{cat}$ values lower than or comparable to CP4 EPSPS and much lower than wild-type maize EPSPS. The variants T102I-P106A, T102I-P106S, T102I-P106T, T102L-P106V, and T102G-P106W had $K_m$ (PEP) values lower than or comparable to either CP4 EPSPS or wild-type maize EPSPS. All the double-mutant EPSPS variants had $IC_{50}$ measurements that were considerably higher than the wild-type maize EPSPS.

TABLE 2

G101X-T102X-P106X EPSPS Variant Enzymatic Activity Assay

| EPSPS | $V_{max}$ | SE | $k_{cat}$ ($s^{-1}$) | SE | $K_m$ (PEP) | SE | $K_m$ (S3P) | SE | $IC_{50}$ | SE |
|---|---|---|---|---|---|---|---|---|---|---|
| T102G-P106S | 15.3 | 0.51 | 11.73 | 0.5 | 22.97 | 2.4 | 31.4 | 4.48 | 7.8 | 0.29 |
| T102G-P106W | 13.0 | 0.29 | 9.98 | 0.3 | 18.38 | 1.38 | 20.85 | 3.18 | 13.2 | 0.45 |
| T102I-P106A | 5.6 | 0.23 | 4.3 | 0.2 | 8.35 | 1.53 | 11.33 | 2.32 | 19.93 | 2.59 |
| T102I-P106S | 6.8 | 0.22 | 5.21 | 0.2 | 9.42 | 1.3 | 13.88 | 3.66 | 14.15 | 2.15 |
| T102I-P106T | 9.0 | 0.17 | 6.93 | 0.2 | 11.66 | 0.9 | 19.59 | 3.59 | 19.35 | 2.55 |
| T102L-P106V | 11.6 | 0.24 | 8.92 | 0.2 | 14.15 | 1.08 | 19 | 3.02 | 10.37 | 0.09 |
| T102V-P106S | 15.3 | 0.51 | 11.73 | 0.5 | 22.97 | 2.4 | 31.4 | 4.48 | 7.8 | 0.29 |
| CP4 EPSPS | 11.2 | 0.36 | 8.63 | 0.4 | 15.85 | 1.84 | 28.27 | 4.26 | 140 | 4.73 |
| Maize EPSPS | 14.0 | 0.57 | 10.76 | 0.6 | 20.58 | 2.75 | 30.61 | 4.45 | 0.6 | N.D. |

Transgenic maize plants that expressed each of the double-mutant EPSPS variants were generated to determine if the variants conferred glyphosate tolerance to plants. The full genomic DNA sequence encoding the wild-type maize EPSPS (provided herein as SEQ ID NO:319) was cloned from maize genomic DNA. In this sequence, the promoter and 5' UTR are nucleotides 1:2556; the chloroplast transit sequence is nucleotides 2557:2742; EXON 1 is nucleotides 2743:2856; INTRON 1 is nucleotides 2857:3384; EXON 2 is nucleotides 3385:3626; INTRON 2 is nucleotides 3627:3725; EXON 3 is nucleotides 3726:3879; INTRON 3 is nucleotides 3880:4152; EXON 4 is nucleotides 4153:4367; INTRON 4 is nucleotides 4368:4877; EXON 5 is nucleotides 4878:4995; INTRON 5 is nucleotides 4996:5155; EXON 6 is nucleotides 5156:5366; INTRON 6 is nucleotides 5367:5446; EXON 7 is nucleotides 5447:5508; INTRON 7 is nucleotides 5509:5617; EXON 8 is nucleotides 5618:5836; and the 3' UTR is nucleotides 5837:6368 (FIG. 3). Mutations were then introduced into the EPSPS coding sequence in order to produce each double-mutant EPSPS variant to be tested. These mutated full genomic DNA sequences were then cloned as a single expression cassette into plant transformation vectors, which were used with *Agrobacterium tumefaciens* and standard methods for plant transformation using methods known in the art. Regenerated $R_0$ transgenic plantlets were grown in the greenhouse, single-copy plants were identified, and these were divided into control and treatment groups. Plants in the treatment group were sprayed with glyphosate applied postemergence (POST) at 3 lb. ae/acre (3.36 kg ae/ha) at the V3-V4 stage. Treated plants were evaluated for injury 1 to 14 days after glyphosate application. Each individual plant represented a unique event, and multiple events were tested for each EPSPS variant (recorded as "n"). Individual plants having injury scores of 10% or less were scored as passing the herbicide tolerance screen, thus demonstrating glyphosate tolerance. The percentage of unique events passing the herbicide tolerance screen was calculated. Table 3 shows the plant testing data. Wild-type maize had no plants passing the herbicide tolerance screen (data not shown), and maize plants expressing the cDNA encoding the CP4 EPSPS in the wild-type maize EPSPS expression construct (that is, wild-type promoter, transit peptide, and 3' UTR) had 50% of plants passing the herbicide tolerance screen. Maize plants expressing the T102G-P106S or T102I-P106A variant maize EPSPS expression construct had approximately 13% of plants passing the herbicide tolerance screen. Maize plants expressing the T102G-P106W or T102V-P106S variant maize EPSPS expression constructs had approximately 18% of plants passing the herbicide tolerance screen. Maize plants expressing the T102I-P106T or T102I-P106S variant maize EPSPS expression construct had approximately 20% and 21% of plants passing the herbicide tolerance screen, respectively.

The average glyphosate tolerance of all the plants containing a single copy of each variant was ranked for percentage glyphosate tolerance. Maize plants expressing the T102G-P106S, T102G-P106W, T102I-P106A, or T102V-P106S variant maize EPSPS expression construct had 10-20% glyphosate tolerance. Maize plants expressing the T102I-P106S or T102I-P106T variant maize EPSPS expression construct had 20-30% glyphosate tolerance. Wild-type maize showed no glyphosate tolerance (data not shown), and maize plants expressing the cDNA encoding the CP4 EPSPS in the wild-type maize EPSPS expression construct (that is, wild-type promoter, transit peptide, and 3' UTR) had >40% glyphosate tolerance.

TABLE 3

Positional EPSPS Variants Plant Testing

| EPSPS Variant | Percentage of Events Passing Spray Screen | Percentage Glyphosate Tolerance |
| --- | --- | --- |
| T102G-P106S | 13.86% n = 34 | 10%-20% |
| T102G-P106W | 18.75% n = 18 | 10%-20% |
| T102I-P106A | 13.21% n = 12 | 10%-20% |
| T102I-P106S | 21.31% n = 18 | 20%-30% |
| T102I-P106T | 20.00% n = 43 | 20%-30% |
| T102L-P106V | 4.69% n = 11 | 1%-10% |
| T102V-P106S | 18.52% n = 28 | 10%-20% |
| CP4 EPSPS | 50.00% n = 18 | >40% |

Leaf samples can be used to identify transgenic plants with a single copy of the transgenic DNA insert. $R_0$ plants that contain a single copy of the transgenic DNA insert and pass the herbicide tolerance screen can be crossed with themselves to produce $R_1$ seed, which may be used for further greenhouse and field testing and breeding.

Example 2: Development and Characterization of Novel EPSPS Variants Using Site Saturation Mutagenesis Site saturated mutagenesis (SSM) libraries of variant maize EPSPS coding sequences were created using methods known in the art and used to produce recombinant proteins to identify mutations in the enzyme that reduce sensitivity to glyphosate. These variant enzymes were then characterized using bacterial and enzymatic assays.

Four SSM libraries were created to generate site saturation mutant libraries using a variation of the technique described in P. C. Jain, R. Varadarajan ("A rapid, efficient, and economical inverse polymerase chain reaction-based method for generating a site saturation mutant library", *Analytical Biochemistry* 449C:90-98 (2013)). Each library was created to produce a collection of EPSPS variants representing a mutation at every amino acid position in the starting protein. The first library was generated using the wild-type maize EPSPS; the second library was generated using the T102I-P106A EPSPS variant ("TIPA"); the third library was generated using the wild-type maize EPSPS but excluding mutations at positions 101, 102, and 106; and the fourth library was generated using the TIPA variant EPSPS but excluding mutations at positions 101, 102, and 106. The resulting approximately 64,000 unique EPSPS variants had changes at one or more amino acid positions in the EPSPS protein.

Approximately 64,000 unique coding sequences for the EPSPS variants from the four libraries were cloned into bacterial plasmids and transformed into an aroA-defective strain of *E. coli*. The transformed cells were then grown in liquid medium containing one of six different glyphosate concentrations: 0, 0.25 mM, 0.5 mM, 1 mM, 5 mM, and 10 mM. Cultures that showed bacterial growth were harvested at 0, 16, 22, and 38 hours. DNA plasmids were prepared from each of the cultures showing bacterial growth and the EPSPS gene in each was sequenced. The resulting glyphosate-tolerant EPSPS variants were identified: T102I-P106A-L280R; N28S-T102I-P106A; N28Q-T102I-P106A; A103F; A103V; A114K; A295F; A340Y; A35M; A58I; A71M; A71M-T102I-P106A; C426M; D331M; E130R; E378L; E378W; E38F; E50F; E50F-T102I-P106A; E67C; T102I-P106A; G101E-T102I-P106A; G194Q; G315K; G39K-T102I-P106A; G39W; G63L-T102I-P106A; G82Q; I6P; I6W; K170V; K203A; K328F; K70L-T102I-P106A; K70W; K73P-T102I-P106A; L107T; L191D; L280D; L33E-T102I-P106A; L36E; L46C-T102I-P106A; L46D; L46D-T102I-P106A; L46W-T102I-P106A; L56E-T102I-P106A; L56K-T102I-P106A; L62F-T102I-P106A; L64G-T102I-P106A; M326A; N161W; N28A-T102I-P106A; N28C-T102I-P106A; N28G-T102I-P106A; N28M-T102I-P106A; N28T-T102I-P106A; N28V-T102I-P106A; N45G-T102I-P106A; P106A; P132D; R219F; R350K; R60E; R60E-T102I-P106A; R60K; R60Q-T102I-P106A; S65K; S65Q-T102I-P106A; S65R-T102I-P106A; T102F; T102I; T102I-A103D-P106A; T102I-P106A-A114C; T102I-P106A-A118F; T102I-P106A-E288I; T102I-P106A-E379M; T102I-P106A-G124K; T102I-P106A-L107K; T102I-P106A-L122D; T102I-P106A-P418G; T102I-P106A-S179I; T102I-P106A-T112V; T102I-P106A-T112W; T102I-P106A-T307W; T102I-P106A-Y383E; T102I-R105A-P106A; T17M; T41H; T61E; T61E-T102I-P106A; V111N; V111Q; V160P; V297Q; V332K; V332Q; V43P; V43Q; V77N; V86C; and Y54G (positions relative to the wild-type maize EPSPS provided as SEQ ID NO:1).

Plants expressing each of the glyphosate-tolerant EPSPS variants can be produced and tested as described in Example 1. Mutations are introduced into the EPSPS coding sequence of the full genomic DNA sequence encoding the wild-type maize EPSPS (provided herein as SEQ ID NO:319) in order to produce each EPSPS variant to be tested. These mutated full genomic DNA sequences are cloned as a single expression cassette into plant transformation vectors, which are used with *Agrobacterium tumefaciens* and standard methods for plant transformation using methods known in the art. Regenerated $R_0$ transgenic plantlets are grown in the greenhouse, single-copy plants are identified, and these are divided into control and treatment groups. Plants in the treatment group are sprayed with glyphosate applied post-emergence (POST) at 3 lb. ae/acre (3.36 kg ae/ha) at the V3-V4 stage. Treated plants are evaluated for injury 1 to 14 days after glyphosate application. Each individual plant represents a unique event, and multiple events are tested for each EPSPS variant (recorded as "n"). Individual plants having injury scores of 10% or less are scored as passing the herbicide tolerance screen, thus demonstrating glyphosate tolerance. The percentage of unique events passing the herbicide injury number of single copy plants having injury scores of 10% or less is recorded.

Maize plants expressing a single-copy of the N28S-T102I-P106A variant maize EPSPS expression construct were tested, and 20.2% of plants passed the herbicide tolerance screen, while maize plants expressing a single-copy of the T102I-P106A variant maize EPSPS expression construct had 13.21% of plants passing the herbicide tolerance screen, respectively. Wild-type maize had no plants passing the herbicide tolerance screen (data not shown), and maize plants expressing the cDNA encoding the CP4 EPSPS in the wild-type maize EPSPS expression construct (that is, wild-type promoter, transit peptide, and 3' UTR) had 50% of plants passing the herbicide tolerance screen. Data are shown in Table 4.

The average glyphosate tolerance of all the plants containing a single copy of each variant is ranked for percentage glyphosate tolerance. Maize plants expressing a single-copy of the N28S-T102I-P106A variant maize EPSPS expression construct were tested, and 20-30% had glyphosate tolerance, while maize plants expressing a single-copy of the T102I-P106A variant maize EPSPS expression construct had 10-20% glyphosate tolerance. Wild-type maize showed no glyphosate tolerance (data not shown), and maize plants expressing the cDNA encoding the CP4 EPSPS in the wild-type maize EPSPS expression construct (that is, wild-type promoter, transit peptide, and 3' UTR) had >40% glyphosate tolerance.

TABLE 4

Combinatorial EPSPS Variants Plant Testing

| EPSPS Variant | Percentage of Events with One Copy of Transgene Passing Spray Screen | Percentage Glyphosate Tolerance |
|---|---|---|
| N28S-T102I-P106A | 20.20% n = 31 | 20%-30% |
| T102I-P106A | 13.21% n = 12 | 10%-20% |

Leaf samples can be used to identify transgenic plants with a single copy of the transgenic DNA insert. $R_0$ plants that contain a single copy of the transgenic DNA insert and pass the herbicide tolerance screen can be crossed with themselves to produce $R_1$ seed, which may be used for further greenhouse and field testing and breeding.

Example 3: Development and Characterization of Novel Combinatorial EPSPS Variants Novel combinatorial EPSPS variants were created using the G101X-T102X-P106X EPSPS variants that showed improved enzyme kinetics and the EPSPS variants generated from the four SSM libraries. Variants that had been identified in those screens as conferring glyphosate tolerance using the bacterial growth assay or as having improved enzyme kinetics were used to create an additional set of combinatorial EPSPS variants. These variants combined multiple previously identified mutations that had been found individually to result in improved glyphosate-tolerance. The EPSPS variants were cloned into bacterial plasmids and transformed into aroA-defective strain *E. coli*. A bacterial growth assay was used to identify EPSPS variants that provided resistance to glyphosate as described above. The resulting glyphosate-tolerant EPSPS variants were: T102G-P106W-L280R; T102G-P106S-L280R; I6P-T102G-P106W; I6P-T102G-P106S; T102G-P106W-L280D; T102G-P106S-L280D; T102G-P106W-E130R; T102G-P106S-E130R; T102G-P106W-E378L; T102G-P106S-E378L; G39W-T102G-P106W; G39W-T102G-P106S; R60E-T102G-P106W; R60E-T102G-P106S; I6P-R60E-T102G-P106W-E130R-L280D; and I6P-R60E-T102G-P106S-E130R-L280D (positions relative to the wild-type maize EPSPS provided as SEQ ID NO:1). Mutations can be introduced into the EPSPS coding sequence of the full genomic DNA sequence encoding the wild-type maize EPSPS (provided herein as SEQ ID NO:319) in order to produce each of these EPSPS variants. These variants can be tested for glyphosate tolerance in plants as described in Examples 1 and 2 above.

Example 4: Development and Characterization of Novel T102X-A103X-P106X-L107X EPSPS Variants Novel combinatorial EPSPS variants at amino acid positions 102, 103, 106, and 107 (relative to the wild-type maize EPSPS provided as SEQ ID NO:1) were created using the data produced from the positional variants (G101X-T102X-P106X) and the four SSM libraries. These variants combined multiple previously identified mutations at positions 102, 103, 106, and 107 that had been found individually to result in improved glyphosate-tolerance in EPSPS variants. EPSPS variants were cloned into bacterial plasmids and transformed into aroA-defective strain *E. coli*. The transformed cells were then grown in liquid medium containing one of six different glyphosate concentrations: 0, 0.25 mM, 0.5 mM, 1 mM, 5 mM, and 10 mM. Cultures that showed bacterial growth were harvested at 0, 16, 22, and 38 hours. Plasmid DNA was prepared from each of the cultures showing bacterial growth and the EPSPS gene in each was sequenced. The resulting glyphosate-tolerant EPSPS variants were: T102Q-A103P-P106A-L107F; T102V-A103V-P106C-L107F; A103G-P106L-L107M; T102L-A103V-P106Q-L107S; T102L-A103V-P106S-L107G; T102G-A103V-P106S-L107V; T102L-A103L-P106S-L107W; T102I-P106S-L107G; T102V-P106S-L107A; T102V-A103V-P106A-L107Q; T102G-A103C-P106W; T102L-A103L-P106V-L107Q; T102I-A103V-P106G-L107T; P106I-L107S; T102I-A103V-P106S; T102L-A103V-P106C-L107C; T102V-A103I-P106T-L107C; and T102L-A103V-P106S-L107M (relative to the wild-type maize EPSPS provided as SEQ ID NO:1). Mutations can be introduced into the EPSPS coding sequence of the full genomic DNA sequence encoding the wild-type maize EPSPS (provided herein as SEQ ID NO:319) in order to produce each of these EPSPS variants. These variants can be tested for glyphosate tolerance in plants as described in Examples 1 and 2 above.

Example 5: Development and Characterization of Additional Novel EPSPS Variants Twenty-five novel combinatorial EPSPS variants were created by analysis of the data produced from single- and multiple-point mutation EPSPS variants in enzyme kinetics assays and bacterial growth assays. The resulting EPSPS variants created were: N28Q-R60K-A71M-T102G-P106S-K203A-T269C-E378L, N28Q-R60K-T102G-P106S-E378L, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, R60E-P106I-L107S-E378L, R60E-T102G-A103C-P106W-G115S-E378L, R60E-T102G-A103V-P106S-L107V-E378L, R60E-T102G-P106S-E378L, and R60K-T102G-P106S-E378L (relative to the wild-type maize EPSPS provided as SEQ ID NO:1). These combinations of mutations can be introduced into the EPSPS coding sequence of the full genomic DNA sequence encoding the wild-type maize EPSPS (provided herein as SEQ ID NO:319) in order to produce each of these EPSPS variants. These variants can be tested for glyphosate tolerance in plants as described in Examples 1 and 2 above.

Example 6: Identification of Improved Glyphosate-Tolerant EPSPS Variants

Improved EPSPS variants were identified using data from several methods including: a site-saturated mutagenesis library screened under glyphosate pressure, sequence comparison and phylogenetic analysis, homology modelling, literature mining and rational design. In many cases, variants were designed using a base "scaffold" variant containing mutations at two or more of residues T102, A103, P106, L107 (positions relative to the wild-type maize EPSPS provided as SEQ ID NO:1) combined with one or more mutations at non-scaffold residues.

Expression and extraction of the EPSPS variants was performed in 24-well blocks. Two replicates consisting of 50 µL overnight stocks of E. coli were inoculated into separate wells containing 5 mL of auto induction media with 25 µg/mL kanomycin and 25 ug/mL chloramphenicol. The E. coli cultures were grown at 37° C. for 2 hours, followed by 15.6° C. overnight. The cells from each replicate were combined and harvested by centrifugation. The pellets were frozen until protein extraction.

Frozen pellets were thawed with metal beads to loosen the pellet and then extracted at 4° C. in 2 mL of 50 mM Tris pH 8.0, Bper: Yper 3:1, 250 mM NaCl, 10 mM imidazole, lysozyme 1 mg/100 ml, benzonase 10 ul (750U/µl)/100 ml. The mixture was centrifuged for 15 minutes and the resulting supernatants were transferred to a new 24-well block. 250 µl of Ni-NTA beads (preequilibrated with washing buffer) were added to each supernatant. The blocks were shaken at 4° C. for 1 hour and the beads were then collected into wells in a filter plate by centrifugation for 1 minute. The beads were washed successively in the filter plate by adding several bed volumes of 25 mM Tris pH 8.0, 250 mM NaCl, 20 mM imidazole, followed by 25 mM Tris pH 8.0, 250 mM NaCl, 50 mM imidazole, and then centrifuging at 500×g for 1 minute. The protein was eluted by two successive washes of 350 µL 20 mM Tris pH 8.0, 250 mM NaCl, 200 mM imidazole. The protein samples were desalted using Zeba desalt plates. Four washes of 250 µL 15.4 mM Tris, pH 7.4, 130 mM NaCl, 1% glycerol were performed to equilibrate the resin, and then 100 uL of variant protein from the first 200 mM imidazole was desalted by centrifugation for 2 minutes. The proteins were normalized to 400 ppm into 4×25 uL aliquots, flash frozen, and stored until kinetic analysis.

For kinetic studies, one or more of the base "scaffold" variants and wild-type maize EPSPS were usually analyzed as controls alongside the single, stacking, and complex variants. Replicated single point activity measurements at a saturating concentration of PEP were used to initially screen 352 EPSPS variants. Some of the variants, particularly those with mutations at amino acid residues T102, A103, P106, L107 (positions relative to the wild-type maize EPSPS provided as SEQ ID NO:1), were inactive or unstable and thus were not advanced (data not shown). Forty-eight variants were advanced for further kinetic analysis. Enzyme kinetic measurements for $k_{cat}$, $K_m$ (PEP), and $I_{0.5}$ (in the presence of glyphosate) were generated. Using this data, the specificity constant ($k_{cat}/K_m$) and $k_{cat}*I_{0.5}/K_m$ values, which are useful to compare the overall quality of the variant enzymes, were calculated for each variant. Data for $k_{cat}$ ($s^{-1}$), $K_m$ PEP (µM), the specificity constant, $I_{0.5}$ (mM), and $k_{cat}*I_{0.5}/K_m$ is shown in Table 5.

TABLE 5

Kinetic Parameters of Maize EPSPS Variants (Ranked by $k_{cat}*I_{0.5}/K_m$).

| EPSPS Variant | $k_{cat}$ ($s^{-1}$) | $K_m$ PEP (µM) | Specificity Constant ($k_{cat}/K_m$) | $I_{0.5}$ (mM) | $k_{cat}*I_{0.5}/K_m$ |
|---|---|---|---|---|---|
| A71M-T102G-A103V-P106L-L107V | 8.8 | 10.1 | 0.9 | 25.7 | 22.4 |
| V125D | 14.4 | 13.8 | 1.0 | 21.2 | 22.1 |
| T278N | 18.1 | 17.0 | 1.1 | 20.1 | 21.5 |
| T17M | 8.3 | 7.5 | 1.1 | 16.3 | 18.1 |
| I133M | 8.1 | 9.8 | 0.8 | 18.8 | 15.5 |
| A333I | 15.9 | 16.1 | 1.0 | 13.3 | 13.1 |
| T17M-A71M-T102G-A103V-P106S-L107V | 8.8 | 15.5 | 0.6 | 20.4 | 11.6 |
| N28H-T102G-P106S | 7.3 | 6.1 | 1.2 | 9.5 | 11.3 |
| N28Q-T102G-A103V-P106S-L107V | 8.5 | 7.1 | 1.2 | 8.7 | 10.4 |
| R60E-T102G-A103V-P106S-L107V-T278N-E378L | 7.8 | 8.9 | 0.9 | 11.8 | 10.3 |
| T102G-P106S-T269C | 9.6 | 27.2 | 0.4 | 28.0 | 9.9 |
| N28S-T102G-A103V-P106S-L107V | 9.8 | 23.6 | 0.4 | 23.0 | 9.5 |
| N28H-T102G-A103V-P106S-L107V | 11.9 | 15.9 | 0.7 | 12.2 | 9.1 |
| T102G-A103V-P106L-L107V-T269C | 10.3 | 19.5 | 0.5 | 16.1 | 8.5 |
| P106L | 7.8 | 20.1 | 0.4 | 20.6 | 8.0 |
| T17M-T102G-A103V-P106S-L107V-T269C | 6.1 | 7.6 | 0.8 | 9.9 | 8.0 |
| T102G-A103V-P106S-L107V | 13.6 | 20.5 | 0.7 | 12.0 | 8.0 |
| R60K-T102G-A103V-P106S-L107V-T269C-E378L | 10.7 | 10.6 | 1.0 | 7.5 | 7.6 |
| T17M-N28Q-R60K-T102G-A103V-P106S-L107V-E378L | 5.5 | 5.9 | 0.9 | 7.8 | 7.3 |
| T102G-A103V-P106S-L107V-T269C-T278N | 9.1 | 15.5 | 0.6 | 11.9 | 7.0 |
| T102G-A103R-P106C | 12.1 | 10.2 | 1.2 | 5.8 | 6.9 |
| S65K-A71M-T102G-A103V-P106S-L107V | 10.7 | 20.4 | 0.5 | 13.0 | 6.8 |
| T102G-P106S-V125D | 9.0 | 10.3 | 0.9 | 7.6 | 6.6 |
| T102I-P106A-L280R | 4.9 | 14.0 | 0.4 | 17.6 | 6.2 |
| R60K-T102G-P106S-E379N | 6.4 | 8.9 | 0.7 | 8.4 | 6.0 |
| R60E-T102G-A103C-P106W-G115S-E378L | 14.9 | 32.0 | 0.5 | 12.8 | 5.9 |
| P190L | 20.2 | 56.0 | 0.4 | 15.7 | 5.7 |
| A71M-T102G-A103V-P106S-L107V-E379N | 8.6 | 13.7 | 0.6 | 8.7 | 5.5 |
| R60E-T102G-A103V-P106S-L107V-E378L | 7.3 | 25.2 | 0.3 | 17.7 | 5.1 |
| T102I-P106A-E379M | 8.5 | 28.1 | 0.3 | 15.2 | 4.6 |
| A71M-T102G-A103V-P106S-L107V-V125D | 11.9 | 49.3 | 0.2 | 17.9 | 4.3 |
| N28Q-R60K-T102G-P106S-E378L | 10.4 | 16.7 | 0.6 | 6.3 | 3.9 |
| T102I-A103V-P106G-L107T | 5.2 | 29.8 | 0.2 | 20.8 | 3.6 |
| T102V-P106S-L107A | 7.4 | 36.2 | 0.2 | 15.3 | 3.1 |
| N28T-T102G-P106S | 7.3 | 33.3 | 0.2 | 14.1 | 3.1 |

TABLE 5-continued

Kinetic Parameters of Maize EPSPS Variants (Ranked by $k_{cat}*I_{0.5}/K_m$).

| EPSPS Variant | $k_{cat}$ (s$^{-1}$) | $K_m$ PEP (μM) | Specificity Constant ($k_{cat}/K_m$) | $I_{0.5}$ (mM) | $k_{cat}*I_{0.5}/K_m$ |
|---|---|---|---|---|---|
| R60K-T102G-P106W | 9.1 | 68.5 | 0.1 | 17.7 | 2.4 |
| T102G-A103C-P106W | 8.9 | 34.1 | 0.3 | 7.3 | 1.9 |
| N28Q-T102G-P106S | 9.9 | 67.9 | 0.1 | 11.2 | 1.6 |
| L64G-T102G-P106S | 8.9 | 79.7 | 0.1 | 12.5 | 1.4 |
| T102G-A103C-P106W-G115S | 9.1 | 42.5 | 0.2 | 6.2 | 1.3 |
| R60E-T102G-P106S | 6.4 | 58.5 | 0.1 | 12.0 | 1.3 |
| N28V-T102I-P106A | 5.2 | 86.0 | 0.1 | 21.1 | 1.3 |
| T102G-P106S-V111N | 2.4 | 51.0 | 0.0 | 14.1 | 0.7 |
| T17M-N28Q-R60K-A71M-T102G-A103V-P106S-L107V-K203A-T269C-E378L | 5.5 | 118.2 | 0.0 | 7.8 | 0.4 |
| T102G-P106W-K203A | 12.8 | 32.3 | 0.4 | 0.6 | 0.2 |
| A71M | 13.6 | 25.1 | 0.5 | 0.4 | 0.2 |
| S65K | 15.9 | 40.4 | 0.4 | 0.6 | 0.2 |
| P106I-L107S | 5.2 | 48.4 | 0.1 | 1.4 | 0.1 |

Under high glyphosate pressure, high $k_{cat}$, low $K_m$, and high $I_{0.5}$ values are desirable for identifying improved EPSPS variants. Most active variants had high $I_{0.5}$ values, which was not surprising since many variants consisted of mutations stacked onto base "scaffold" variants that have been previously been identified as conferring glyphosate tolerance (e.g. T102G-P106S, T102G-P106W, T102I-P106A). However, these variants generally had considerably low $k_{cat}$ or high $K_m$ values, which are both considered undesirable as they indicate a lower binding affinity for PEP. Furthermore, variants with acceptable $k_{cat}$ and $I_{0.5}$ values generally had higher $K_m$ values. However, some variants with high $k_{cat}$ values had $K_m$ values comparable to or lower than that of wild-type maize EPSPS. These improved variants were considered also substantially better in each of the measured kinetic properties ($k_{cat}$, $K_m$, $I_{0.5}$) than any of the original TIPA-like variants. Some of these variants have 'better' combined ($k_{cat}*I_{0.5}/K_m$) kinetic parameters than the TIPA-like variants and at least one variant (V125D) was superior for all three kinetic parameters. These improved EPSPS variants are expected to impart glyphosate tolerance to maize plants and, based on their kinetics, have the capability to adequately substitute for the function of wild-type EPSPS throughout the life cycle of the plant. These improved variants can be tested for glyphosate tolerance in plants as described in Examples 1 and 2 above.

Example 7: Plant Testing of Novel EPSPS Variants

EPSPS variants may be tested for their ability to confer glyphosate tolerance to crop plants using any method known in the art to introduce specific mutations into the plant genome, insert DNA in a site-specific manner, or introduce a transgenic expression cassette into the plant genome.

Transgenic maize plants containing EPSPS variants were tested for glyphosate tolerance. Mutations were introduced into the EPSPS coding sequence of the full genomic DNA sequence encoding the wild-type maize EPSPS (provided herein as SEQ ID NO:319) in order to produce each EPSPS variant to be tested. These mutated full genomic DNA sequences were cloned as a single expression cassette into plant transformation vectors, which were used with *Agrobacterium tumefaciens* and standard methods for plant transformation using methods known in the art. The variant proteins were expressed using native maize EPSPS expression elements. Transgenic maize plants containing *Agrobacterium tumefaciens* strain CP4 EPSPS were used as controls. The CP4 gene in these plants was either expressed under the native maize EPSPS promoter (P-Zm.EPSPS:1) or a rice a-tubulin promoter (P-Os.TubA-3:4:6). Transformations were done under glyphosate selection.

Glyphosate tolerance of the $R_0$ events was tested in the greenhouse. Glyphosate was applied at spray rates of 3.0 lb ae/acre (4× rate) at the V3 growth stage. Glyphosate-induced plant injury was evaluated visually, based on estimation of plant epinasty (bending or twisting of the leaf), growth reduction, chlorosis, and necrosis. Individual plants having injury scores of 20% or less were scored as passing the herbicide tolerance screen, thus demonstrating glyphosate tolerance. The percentage of events passing the herbicide tolerance screen was calculated. Table 6 shows the plant testing data.

TABLE 6

| Results of Testing of EPSPS Variants in Maize Plants. | | | | | |
|---|---|---|---|---|---|
| EPSPS Variant | Promoter | Targeting Sequence | 3' UTR | Number of $R_0$ Events Sprayed with Glyphosate | % of Events That Showed ≤20% Injury |
| CP4 (control) | P-Os.TubA-3:4:6 | TS_AtShkG-CTP2:1 | T-Os.TubA-3:1:1 | 35 | 91% |
| CP4 (control) | P-Zm.EPSPS:1 | TS-Zm.EPSPS-1:1:1 | T-Os.TubA-3:1:1 | 84 | 62% |
| G39W-T102G-P106S | P-Zm.EPSPS:1 | TS-Zm.EPSPS-1:1:1 | T-Zm.EPSPS-1:1:1 | 54 | 46% |
| G39W-T102G-P106W | P-Zm.EPSPS:1 | TS-Zm.EPSPS-1:1:1 | T-Zm.EPSPS-1:1:1 | 97 | 69% |
| I6P-R60E-T102G-P106W-E130R-L280D | P-Zm.EPSPS:1 | TS-Zm.EPSPS-1:1:1 | T-Zm.EPSPS-1:1:1 | 65 | 8% |
| I6P-T102G-P106S | P-Zm.EPSPS:1 | TS-Zm.EPSPS-1:1:1 | T-Zm.EPSPS-1:1:1 | 98 | 61% |
| N28Q-T102I-P106A | P-Zm.EPSPS:1 | TS-Zm.EPSPS-1:1:1 | T-Zm.EPSPS-1:1:1 | 107 | 84% |

TABLE 6-continued Results of Testing of EPSPS Variants in Maize Plants.

| EPSPS Variant | Promoter | Targeting Sequence | 3' UTR | Number of $R_0$ Events Sprayed with Glyphosate | % of Events That Showed ≤20% Injury |
|---|---|---|---|---|---|
| N28S-T102I-P106A | P-Zm.EPSPS:1 | TS-Zm.EPSPS-1:1:1 | T-Zm.EPSPS-1:1:1 | 99 | 82% |
| R60E-T102G-P106W | P-Zm.EPSPS:1 | TS-Zm.EPSPS-1:1:1 | T-Zm.EPSPS-1:1:1 | 67 | 93% |
| G101A-A192T | P-Zm.EPSPS:1 | TS-Zm.EPSPS-1:1:1 | T-Zm.EPSPS-1:1:1 | 16 | 63% |
| G101A-G144D | P-Zm.EPSPS:1 | TS-Zm.EPSPS-1:1:1 | T-Zm.EPSPS-1:1:1 | 15 | 73% |
| I6P-T102G-P106W | P-Zm.EPSPS:1 | TS-Zm.EPSPS-1:1:1 | T-Zm.EPSPS-1:1:1 | 74 | 64% |
| R60E-T102G-P106S | P-Zm.EPSPS:1 | TS-Zm.EPSPS-1:1:1 | T-Zm.EPSPS-1:1:1 | 80 | 44% |
| T102G-A103C-P106W | P-Zm.EPSPS:1 | TS-Zm.EPSPS-1:1:1 | T-Zm.EPSPS-1:1:1 | 3 | 100% |
| T102G-A103V-P106S-L107V | P-Zm.EPSPS:1 | TS-Zm.EPSPS-1:1:1 | T-Zm.EPSPS-1:1:1 | 156 | 55% |
| T102G-P106S | P-Zm.EPSPS:1 | TS-Zm.EPSPS-1:1:1 | T-Zm.EPSPS-1:1:1 | 95 | 36% |
| T102G-P106S-E378L | P-Zm.EPSPS:1 | TS-Zm.EPSPS-1:1:1 | T-Zm.EPSPS-1:1:1 | 59 | 61% |
| T102G-P106S-L280D | P-Zm.EPSPS:1 | TS-Zm.EPSPS-1:1:1 | T-Zm.EPSPS-1:1:1 | 7 | 29% |
| T102G-P106W | P-Zm.EPSPS:1 | TS-Zm.EPSPS-1:1:1 | T-Zm.EPSPS-1:1:1 | 84 | 68% |
| T102G-P106W-E130R | P-Zm.EPSPS:1 | TS-Zm.EPSPS-1:1:1 | T-Zm.EPSPS-1:1:1 | 51 | 61% |
| T102G-P106W-E378L | P-Zm.EPSPS:1 | TS-Zm.EPSPS-1:1:1 | T-Zm.EPSPS-1:1:1 | 15 | 53% |
| T102G-P106W-L280R | P-Zm.EPSPS:1 | TS-Zm.EPSPS-1:1:1 | T-Zm.EPSPS-1:1:1 | 70 | 63% |
| T102I-P106S-L107G | P-Zm.EPSPS:1 | TS-Zm.EPSPS-1:1:1 | T-Zm.EPSPS-1:1:1 | 80 | 58% |
| T102I-A103V-P106G-L107T | P-Zm.EPSPS:1 | TS-Zm.EPSPS-1:1:1 | T-Zm.EPSPS-1:1:1 | 4 | 75% |
| T102I-A103V-P106S | P-Zm.EPSPS:1 | TS-Zm.EPSPS-1:1:1 | T-Zm.EPSPS-1:1:1 | 217 | 75% |
| T102I-P106A | P-Zm.EPSPS:1 | TS-Zm.EPSPS-1:1:1 | T-Zm.EPSPS-1:1:1 | 59 | 66% |
| T102I-P106A-L280R | P-Zm.EPSPS:1 | TS-Zm.EPSPS-1:1:1 | T-Zm.EPSPS-1:1:1 | 126 | 52% |
| T102I-P106S | P-Zm.EPSPS:1 | TS-Zm.EPSPS-1:1:1 | T-Zm.EPSPS-1:1:1 | 61 | 90% |
| T102I-P106T | P-Zm.EPSPS:1 | TS-Zm.EPSPS-1:1:1 | T-Zm.EPSPS-1:1:1 | 148 | 74% |
| T102L-A103L-P106S-L107W | P-Zm.EPSPS:1 | TS-Zm.EPSPS-1:1:1 | T-Zm.EPSPS-1:1:1 | 122 | 72% |
| T102L-A103L-P106V-L107Q | P-Zm.EPSPS:1 | TS-Zm.EPSPS-1:1:1 | T-Zm.EPSPS-1:1:1 | 14 | 79% |
| T102L-A103V-P106C-L107C | P-Zm.EPSPS:1 | TS-Zm.EPSPS-1:1:1 | T-Zm.EPSPS-1:1:1 | 140 | 62% |
| T102L-A103V-P106Q-L107S | P-Zm.EPSPS:1 | TS-Zm.EPSPS-1:1:1 | T-Zm.EPSPS-1:1:1 | 123 | 74% |
| T102L-A103V-P106S-L107G | P-Zm.EPSPS:1 | TS-Zm.EPSPS-1:1:1 | T-Zm.EPSPS-1:1:1 | 11 | 73% |
| T102L-A103V-P106S-L107M | P-Zm.EPSPS:1 | TS-Zm.EPSPS-1:1:1 | T-Zm.EPSPS-1:1:1 | 130 | 78% |
| T102L-P106V | P-Zm.EPSPS:1 | TS-Zm.EPSPS-1:1:1 | T-Zm.EPSPS-1:1:1 | 72 | 74% |
| P106I-L107S | P-Zm.EPSPS:1 | TS-Zm.EPSPS-1:1:1 | T-Zm.EPSPS-1:1:1 | 173 | 51% |
| A103G-P106L-L107M | P-Zm.EPSPS:1 | TS-Zm.EPSPS-1:1:1 | T-Zm.EPSPS-1:1:1 | 32 | 9% |
| T102V-P106S-L107A | P-Zm.EPSPS:1 | TS-Zm.EPSPS-1:1:1 | T-Zm.EPSPS-1:1:1 | 9 | 78% |
| T102V-A103I-P106T-L107C | P-Zm.EPSPS:1 | TS-Zm.EPSPS-1:1:1 | T-Zm.EPSPS-1:1:1 | 44 | 61% |
| T102V-A103V-P106A-L107Q | P-Zm.EPSPS:1 | TS-Zm.EPSPS-1:1:1 | T-Zm.EPSPS-1:1:1 | 73 | 85% |
| T102V-A103V-P106C-L107F | P-Zm.EPSPS:1 | TS-Zm.EPSPS-1:1:1 | T-Zm.EPSPS-1:1:1 | 80 | 73% |
| T102V-P106S | P-Zm.EPSPS:1 | TS-Zm.EPSPS-1:1:1 | T-Zm.EPSPS-1:1:1 | 130 | 46% |

Maize plants expressing the CP4 EPSPS under the native maize EPSPS promoter had 62% of plants passing the herbicide tolerance screen. A number maize plants expressing variant maize EPSPSs had comparable or higher percentages of plants passing the herbicide tolerance screen compared to plants containing CP4 EPSPS.

Alternatively, plants comprising an EPSPS variant may be produced by inserting DNA directly into the plant genome at a specified targeted location. Any site or locus within the plant genome may potentially be chosen for site-specific integration of a transgene or construct of the present disclosure. For site-specific integration, a double-strand break (DSB) or nick may first be made at a selected genomic locus with a site-specific nuclease, such as, for example, a zinc-finger nuclease, an engineered or native meganuclease, a TALE-endonuclease, or an RNA-guided endonuclease (for example, Cas9, Cpf1, CasX, or CasY). Any method known in the art for site-specific integration may be used. In the presence of a donor template molecule, the DSB or nick may then be repaired by homologous recombination between the homology arm(s) of the donor template and the plant genome, or by non-homologous end joining (NHEJ), resulting in site-specific integration of the insertion sequence into the plant genome to create the targeted insertion event at the site of the DSB or nick.

Plants having one or more mutations in the genomic EPSPS gene may be produced using a double-strand break (DSB) or nick made at the EPSPS genomic locus with a site-specific nuclease, such as, a zinc-finger nuclease, an engineered or native meganuclease, a TALE-endonuclease, or an RNA-guided endonuclease (for example, Cas9, Cpf1, CasX, or CasY). Any method known in the art for genome editing or non-templated editing may be used. Delivery methods for the nuclease and gRNA include, but are not limited to, delivering by *Agrobacterium*-mediated methods, delivering as a protein or RNA using transfection or biolistics, and delivery by expression from a virus. One or more nucleases or gRNA may be used. Donor molecules to deliver the desired changes may include, but are not limited to, double-stranded DNA, single-stranded DNA oligonucleotides, RNA or viral DNA. Donor molecules may be delivered by *Agrobacterium*, virus, biolistic delivery, or transfection. In the presence of a donor template molecule, the one or more DSBs or nicks may then be repaired by homologous recombination between the homology arm(s) of the donor template and the plant genome, by non-homologous end joining (NHEJ), by single-strand annealing pathway or other DNA repair mechanisms resulting in modification of the native sequence in the plant genome to that contained by the donor to create the desired mutation and EPSPS variant.

Modified plants may be grown in the greenhouse and then sprayed with glyphosate applied POST at 3 lb ae/acre (3.36 kg ae/ha) at the V3-V4 stage. Treated plants are evaluated for injury one to fourteen days after treatment and injury scores are recorded. Plants having 20% or less injury are scored as passing the herbicide tolerance screen. Plants that pass the herbicide tolerance screen are selfed to produce $R_1$ seed, which may be used for further greenhouse and field testing and breeding.

$R_1$ plants may be grown in the greenhouse and split into groups. Plants are evaluated for injury one to fourteen days after treatment and injury scores are recorded. The $R_1$ plants may be segregating for the trait in typical Mendelian ratio, and an expected number (approximately 25%) of null segregants (progeny plants not containing the trait) will likely not survive the herbicide treatment. Unsprayed modified plants are used for phenotypic comparison with unsprayed control plants.

SEQUENCE LISTING (412 sequences)

SEQ ID NO: 1 - protein, 444 aa, Zea mays [sequence omitted]

SEQ ID NO: 2 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTFMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 3 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTVMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 4 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAKGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 5 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGFKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 6 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVYLFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 7 - protein, 444 aa, Artificial Sequence
  Synthetic
AGAEEIVLQPIKEISGTVKLPGSKSLSNRILLLAMLSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 8 - protein, 444 aa, Artificial Sequence
  Synthetic
AGAEEIVLQPIKEISGTVKLPGSKSLSNRILLLAALSEGTTVVDNLLNSEDVHYMLGILRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 9 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 10 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 11 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 12 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 13 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGMTRKTFPDYFDVLSTFVKN

SEQ ID NO: 14 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPMVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 15 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 16 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 17 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVWEGPDYCIITPPEKLNVTAIDTYDDHRMAMAFSLAACAEVPVAIRDPGCTRKTFPDYFDVLSTFVKN

SEQ ID NO: 18 - protein, 444 aa, Artificial Sequence
  Synthetic
AGAEEIVLQPIKEISGTVKLPGSKSLSNRILLLAALSFGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 19 - protein, 444 aa, Artificial Sequence
  Synthetic
AGAEEIVLQPIKEISGTVKLPGSKSLSNRILLLAALSFGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 20 - protein, 444 aa, Artificial Sequence
  Synthetic
AGAEEIVLQPIKEISGTVKLPGSKSLSNRILLLAALSFGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 21 - protein, 444 aa, Artificial Sequence
  Synthetic
AGAEEIVLQPIKEISGTVKLPGSKSLSNRILLLAALSEGTTVVDNLLNSFDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 22 - protein, 444 aa, Artificial Sequence
  Synthetic
AGAEEIVLQPIKEISGTVKLPGSKSLSNRILLLAALSEGTTVVDNLLNSFDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 23 - protein, 444 aa, Artificial Sequence
  Synthetic
AGAEEIVLQPIKEISGTVKLPGSKSLSNRILLLAALSEGTTVVDNLLNSFDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 24 - protein, 444 aa, Artificial Sequence
  Synthetic
AGAEEIVLQPIKEISGTVKLPGSKSLSNRILLLAALSEGTTVVDNLLNSFDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 25 - protein, 444 aa, Artificial Sequence
  Synthetic
AGAEEIVLQPIKEISGTVKLPGSKSLSNRILLLAALSEGTTVVDNLLNSEDVHYMLGALRTLGLSVCADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 26 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAEGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 27 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAEGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 28 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAEIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 29 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALQDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 30 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFKRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 31 - protein, 444 aa, Artificial Sequence
  Synthetic
AGAEEIVLQPIKEISGTVKLPGSKSLSNRILLLAALSEKTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 32 - protein, 444 aa, Artificial Sequence
  Synthetic
AGAEEIVLQPIKEISGTVKLPGSKSLSNRILLLAALSEWTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 33 - protein, 444 aa, Artificial Sequence
  Synthetic
AGAEEIVLQPIKEISGTVKLPGSKSLSNRILLLAALSEWTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 34 - protein, 444 aa, Artificial Sequence
  Synthetic
AGAEEIVLQPIKEISGTVKLPGSKSLSNRILLLAALSEWTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 35 - protein, 444 aa, Artificial Sequence
  Synthetic
AGAEEIVLQPIKEISGTVKLPGSKSLSNRILLLAALSEGTTVVDNLLNSEDVHYMLGALRTLLLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 36 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGQKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 37 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 38 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 39 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 40 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 41 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 42 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 43 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 44 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 45 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 46 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 47 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 48 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 49 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 50 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 51 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 52 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 53 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 54 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 55 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 56 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 57 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 58 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 59 - protein, 444 aa, Artificial Sequence
  Synthetic
AGAEEPVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 60 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 61 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 62 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 63 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 64 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 65 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 66 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 67 - protein, 444 aa, Artificial Sequence
  Synthetic
AGAEEPVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 68 - protein, 444 aa, Artificial Sequence
  Synthetic
AGAEEWVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 69 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGVVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 70 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 71 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNFMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 72 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADLAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 73 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADLAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 74 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADLAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 75 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADWAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 76 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADWAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 77 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADWAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 78 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAPRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 79 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAPRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 80 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAPRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 81 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPTTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 82 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPDALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 83 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 84 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSRQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 85 - protein, 444 aa, Artificial Sequence
  Synthetic
AGAEEIVLQPIKEISGTVKLPGSKSLSNRILLEAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 86 - protein, 444 aa, Artificial Sequence
  Synthetic
AGAEEIVLQPIKEISGTVKLPGSKSLSNRILLLAAESEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 87 - protein, 444 aa, Artificial Sequence
  Synthetic
AGAEEIVLQPIKEISGTVKLPGSKSLSNRILLLAAESEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 88 - protein, 444 aa, Artificial Sequence
  Synthetic
AGAEEIVLQPIKEISGTVKLPGSKSLSNRILLLAAESEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 89 - protein, 444 aa, Artificial Sequence
  Synthetic
AGAEEIVLQPIKEISGTVKLPGSKSLSNRILLLAALSEGTTVVDNCLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 90 - protein, 444 aa, Artificial Sequence
  Synthetic
AGAEEIVLQPIKEISGTVKLPGSKSLSNRILLLAALSEGTTVVDNDLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 91 - protein, 444 aa, Artificial Sequence
  Synthetic
AGAEEIVLQPIKEISGTVKLPGSKSLSNRILLLAALSEGTTVVDNDLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 92 - protein, 444 aa, Artificial Sequence
  Synthetic
AGAEEIVLQPIKEISGTVKLPGSKSLSNRILLLAALSEGTTVVDNDLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 93 - protein, 444 aa, Artificial Sequence
  Synthetic
AGAEEIVLQPIKEISGTVKLPGSKSLSNRILLLAALSEGTTVVDNDLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 94 - protein, 444 aa, Artificial Sequence
  Synthetic
AGAEEIVLQPIKEISGTVKLPGSKSLSNRILLLAALSEGTTVVDNWLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 95 - protein, 444 aa, Artificial Sequence
  Synthetic
AGAEEIVLQPIKEISGTVKLPGSKSLSNRILLLAALSEGTTVVDNLLNSEDVHYMEGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 96 - protein, 444 aa, Artificial Sequence
  Synthetic
AGAEEIVLQPIKEISGTVKLPGSKSLSNRILLLAALSEGTTVVDNLLNSEDVHYMEGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 97 - protein, 444 aa, Artificial Sequence
  Synthetic
AGAEEIVLQPIKEISGTVKLPGSKSLSNRILLLAALSEGTTVVDNLLNSEDVHYMEGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 98 - protein, 444 aa, Artificial Sequence
  Synthetic
AGAEEIVLQPIKEISGTVKLPGSKSLSNRILLLAALSEGTTVVDNLLNSEDVHYMKGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 99 - protein, 444 aa, Artificial Sequence
  Synthetic
AGAEEIVLQPIKEISGTVKLPGSKSLSNRILLLAALSEGTTVVDNLLNSEDVHYMKGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 100 - protein, 444 aa, Artificial Sequence
  Synthetic
AGAEEIVLQPIKEISGTVKLPGSKSLSNRILLLAALSEGTTVVDNLLNSEDVHYMKGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 101 - protein, 444 aa, Artificial Sequence
  Synthetic
AGAEEIVLQPIKEISGTVKLPGSKSLSNRILLLAALSEGTTVVDNLLNSEDVHYMLGALRTFGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 102 - protein, 444 aa, Artificial Sequence
  Synthetic
AGAEEIVLQPIKEISGTVKLPGSKSLSNRILLLAALSEGTTVVDNLLNSEDVHYMLGALRTFGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 103 - protein, 444 aa, Artificial Sequence
  Synthetic
AGAEEIVLQPIKEISGTVKLPGSKSLSNRILLLAALSEGTTVVDNLLNSEDVHYMLGALRTFGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 104 - protein, 444 aa, Artificial Sequence
  Synthetic
AGAEEIVLQPIKEISGTVKLPGSKSLSNRILLLAALSEGTTVVDNLLNSEDVHYMLGALRTLGGSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 105 - protein, 444 aa, Artificial Sequence
  Synthetic
AGAEEIVLQPIKEISGTVKLPGSKSLSNRILLLAALSEGTTVVDNLLNSEDVHYMLGALRTLGGSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 106 - protein, 444 aa, Artificial Sequence
  Synthetic
AGAEEIVLQPIKEISGTVKLPGSKSLSNRILLLAALSEGTTVVDNLLNSEDVHYMLGALRTLGGSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 107 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNANKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 108 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVWGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 109 - protein, 444 aa, Artificial Sequence
  Synthetic
AGAEEIVLQPIKEISGTVKLPGSKSLSARILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 110 - protein, 444 aa, Artificial Sequence
  Synthetic
AGAEEIVLQPIKEISGTVKLPGSKSLSARILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 111 - protein, 444 aa, Artificial Sequence
  Synthetic
AGAEEIVLQPIKEISGTVKLPGSKSLSARILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 112 - protein, 444 aa, Artificial Sequence
  Synthetic
AGAEEIVLQPIKEISGTVKLPGSKSLSARILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 113 - protein, 444 aa, Artificial Sequence
  Synthetic
AGAEEIVLQPIKEISGTVKLPGSKSLSCRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 114 - protein, 444 aa, Artificial Sequence
  Synthetic
AGAEEIVLQPIKEISGTVKLPGSKSLSCRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 115 - protein, 444 aa, Artificial Sequence
  Synthetic
AGAEEIVLQPIKEISGTVKLPGSKSLSCRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 116 - protein, 444 aa, Artificial Sequence
  Synthetic
AGAEEIVLQPIKEISGTVKLPGSKSLSGRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 117 - protein, 444 aa, Artificial Sequence
  Synthetic
AGAEEIVLQPIKEISGTVKLPGSKSLSGRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 118 - protein, 444 aa, Artificial Sequence
  Synthetic
AGAEEIVLQPIKEISGTVKLPGSKSLSGRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 119 - protein, 444 aa, Artificial Sequence
  Synthetic
AGAEEIVLQPIKEISGTVKLPGSKSLSGRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 120 - protein, 444 aa, Artificial Sequence
  Synthetic
AGAEEIVLQPIKEISGTVKLPGSKSLSMRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 121 - protein, 444 aa, Artificial Sequence
  Synthetic
AGAEEIVLQPIKEISGTVKLPGSKSLSMRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 122 - protein, 444 aa, Artificial Sequence
  Synthetic
AGAEEIVLQPIKEISGTVKLPGSKSLSMRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 123 - protein, 444 aa, Artificial Sequence
  Synthetic
AGAEEIVLQPIKEISGTVKLPGSKSLSMRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 124 - protein, 444 aa, Artificial Sequence
  Synthetic
AGAEEIVLQPIKEISGTVKLPGSKSLSQRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 125 - protein, 444 aa, Artificial Sequence
  Synthetic
AGAEEIVLQPIKEISGTVKLPGSKSLSQRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 126 - protein, 444 aa, Artificial Sequence
  Synthetic
AGAEEIVLQPIKEISGTVKLPGSKSLSQRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 127 - protein, 444 aa, Artificial Sequence
  Synthetic
AGAEEIVLQPIKEISGTVKLPGSKSLSQRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 128 - protein, 444 aa, Artificial Sequence
  Synthetic
AGAEEIVLQPIKEISGTVKLPGSKSLSSRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 129 - protein, 444 aa, Artificial Sequence
  Synthetic
AGAEEIVLQPIKEISGTVKLPGSKSLSSRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 130 - protein, 444 aa, Artificial Sequence
  Synthetic
AGAEEIVLQPIKEISGTVKLPGSKSLSSRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 131 - protein, 444 aa, Artificial Sequence
  Synthetic
AGAEEIVLQPIKEISGTVKLPGSKSLSTRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 132 - protein, 444 aa, Artificial Sequence
  Synthetic
AGAEEIVLQPIKEISGTVKLPGSKSLSTRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 133 - protein, 444 aa, Artificial Sequence
  Synthetic
AGAEEIVLQPIKEISGTVKLPGSKSLSTRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 134 - protein, 444 aa, Artificial Sequence
  Synthetic
AGAEEIVLQPIKEISGTVKLPGSKSLSTRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 135 - protein, 444 aa, Artificial Sequence
  Synthetic
AGAEEIVLQPIKEISGTVKLPGSKSLSVRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 136 - protein, 444 aa, Artificial Sequence
  Synthetic
AGAEEIVLQPIKEISGTVKLPGSKSLSVRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 137 - protein, 444 aa, Artificial Sequence
  Synthetic
AGAEEIVLQPIKEISGTVKLPGSKSLSVRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 138 - protein, 444 aa, Artificial Sequence
  Synthetic
AGAEEIVLQPIKEISGTVKLPGSKSLSNRILLLAALSEGTTVVDGLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 139 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 140 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERDIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 141 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMEFFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 142 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIKDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 143 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 144 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 145 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 146 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 147 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 148 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 149 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 150 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 151 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 152 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 153 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 154 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 155 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 156 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 157 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 158 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 159 - protein, 444 aa, Artificial Sequence
  Synthetic
AGAEEIVLQPIKEISGTVKLPGSKSLSNRILLLAALSEGTTVVDNLLNSEDVHYMLGALKTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 160 - protein, 444 aa, Artificial Sequence
  Synthetic
AGAEEIVLQPIKEISGTVKLPGSKSLSNRILLLAALSEGTTVVDNLLNSEDVHYMLGALKTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 161 - protein, 444 aa, Artificial Sequence
  Synthetic
AGAEEIVLQPIKEISGTVKLPGSKSLSNRILLLAALSEGTTVVDNLLNSEDVHYMLGALKTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 162 - protein, 444 aa, Artificial Sequence
  Synthetic
AGAEEIVLQPIKEISGTVKLPGSKSLSNRILLLAALSEGTTVVDNLLNSEDVHYMLGALQTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 163 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISIQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 164 - protein, 444 aa, Artificial Sequence
  Synthetic
AGAEEIVLQPIKEISGTVKLPGSKSLSNRILLLAALSEGTTVVDNLLNSEDVHYMLGALRTLGLKVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 165 - protein, 444 aa, Artificial Sequence
  Synthetic
AGAEEIVLQPIKEISGTVKLPGSKSLSNRILLLAALSEGTTVVDNLLNSEDVHYMLGALRTLGLKVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 166 - protein, 444 aa, Artificial Sequence
  Synthetic
AGAEEIVLQPIKEISGTVKLPGSKSLSNRILLLAALSEGTTVVDNLLNSEDVHYMLGALRTLGLKVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 167 - protein, 444 aa, Artificial Sequence
  Synthetic
AGAEEIVLQPIKEISGTVKLPGSKSLSNRILLLAALSEGTTVVDNLLNSEDVHYMLGALRTLGLQVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 168 - protein, 444 aa, Artificial Sequence
  Synthetic
AGAEEIVLQPIKEISGTVKLPGSKSLSNRILLLAALSEGTTVVDNLLNSEDVHYMLGALRTLGLRVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 169 - protein, 444 aa, Artificial Sequence
  Synthetic
AGAEEIVLQPIKEISGTVKLPGSKSLSNRILLLAALSEGTTVVDNLLNSEDVHYMLGALRTLGLRVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 170 - protein, 444 aa, Artificial Sequence
  Synthetic
AGAEEIVLQPIKEISGTVKLPGSKSLSNRILLLAALSEGTTVVDNLLNSEDVHYMLGALRTLGLRVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 171 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGFAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 172 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGCMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 173 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGDMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 174 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGDMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 175 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 176 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 177 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAKGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 178 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGFKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 179 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 180 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 181 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 182 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 183 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 184 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 185 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEMGPDYCIITPPEKLNVTAIDTYDDHRMAMAFSLAACAEVPVAIRDPGCTRKTFPDYFDVLSTFVKN

SEQ ID NO: 186 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALQDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 187 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 188 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSKTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 189 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 190 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 191 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSRQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 192 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVWGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 193 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERDIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 194 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVGVAIRDPGCTRKTFPDYFDVLSTFVKN

SEQ ID NO: 195 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISIQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 196 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVVAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 197 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 198 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVWGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 199 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAANTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 200 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRPNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 201 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKQTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 202 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDKAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 203 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDECIITPPEKLNVTAIDTYDDHRMAMAFSLAACAEVPVAIRDPGCTRKTFPDYFDVLSTFVKN

SEQ ID NO: 204 - protein, 444 aa, Artificial Sequence
  Synthetic
AGAEEIVLQPIKEISGTVKLPGSKSLSNRILLLAALSEGTTVVDNLLNSEDVHGMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 205 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 206 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAKGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 207 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGFKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 208 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 209 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 210 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 211 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRRRPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 212 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 213 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEMGPDYCIITPPEKLNVTAIDTYDDHRMAMAFSLAACAEVPVAIRDPGCTRKTFPDYFDVLSTFVKN

SEQ ID NO: 214 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALQDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 215 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 216 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWKTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 217 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 218 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSDQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 219 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSRQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 220 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVWGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 221 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERDIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 222 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVGVAIRDPGCTRKTFPDYFDVLSTFVKN

SEQ ID NO: 223 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISIQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 224 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVVAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 225 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 226 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVWGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 227 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAANTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 228 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRPNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 229 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKQTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 230 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDKAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 231 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDECIITPPEKLNVTAIDTYDDHRMAMAFSLAACAEVPVAIRDPGCTRKTFPDYFDVLSTFVKN

SEQ ID NO: 232 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMASLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 233 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMAWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 234 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 235 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRSGTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 236 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIDMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 237 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIVMRGTTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 238 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIVMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 239 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 240 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTACGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 241 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNFTYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 242 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAIVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 243 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEMGPDYCIITPPEKLNVTAIDTYDDHRMAMAFSLAACAEVPVAIRDPGCTRKTFPDYFDVLSTFVKN

SEQ ID NO: 244 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDKVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 245 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRAKTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 246 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVDDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 247 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSRQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 248 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVGVAIRDPGCTRKTFPDYFDVLSTFVKN

SEQ ID NO: 249 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISIQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 250 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVVAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 251 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVWAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 252 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVWGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 253 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDECIITPPEKLNVTAIDTYDDHRMAMAFSLAACAEVPVAIRDPGCTRKTFPDYFDVLSTFVKN

SEQ ID NO: 254 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 255 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMRTLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 256 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGIAMAALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 257 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLLMRSWTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 258 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLLMRVQTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 259 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLVMRCCTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 260 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLVMRQSTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 261 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLVMRSGTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 262 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLVMRSMTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 263 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLAMRVLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 264 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGQPMRAFTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 265 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRISTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 266 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTGMRLMTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 267 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGVAMRSATAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 268 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGVIMRTCTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 269 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGVVMRAQTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 270 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGVVMRCFTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 271 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGVAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 272 - protein, 444 aa, Artificial Sequence
  Synthetic
AGAEEIVLQPIKEISGMVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 273 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 274 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVWGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 275 - protein, 444 aa, Artificial Sequence
  Synthetic
AGAEEIVLQPIKEISGTVKLPGSKSLSNRILLLAALSEGTHVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 276 - protein, 444 aa, Artificial Sequence
  Synthetic
AGAEEIVLQPIKEISGTVKLPGSKSLSNRILLLAALSEGTHVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 277 - protein, 444 aa, Artificial Sequence
  Synthetic
AGAEEIVLQPIKEISGTVKLPGSKSLSNRILLLAALSEGTHVVDNLLNSEDVHYMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 278 - protein, 444 aa, Artificial Sequence
  Synthetic
AGAEEIVLQPIKEISGTVKLPGSKSLSNRILLLAALSEGTTVVDNLLNSEDVHYMLGALRELGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 279 - protein, 444 aa, Artificial Sequence
  Synthetic
AGAEEIVLQPIKEISGTVKLPGSKSLSNRILLLAALSEGTTVVDNLLNSEDVHYMLGALRELGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 280 - protein, 444 aa, Artificial Sequence
  Synthetic
AGAEEIVLQPIKEISGTVKLPGSKSLSNRILLLAALSEGTTVVDNLLNSEDVHYMLGALRELGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 281 - protein, 444 aa, Artificial Sequence
  Synthetic
AGAEEIVLQPIKEISGTVKLPGSKSLSNRILLLAALSEGTTVVDNLLNSEDVHYMLGALRELGLSVEADKAAKRAVVVGCGGKFPVEDSKEEVQLFLGNAGIAMRALTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 282 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAANTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 283 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAQTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 284 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRPNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 285 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKQTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 286 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDKAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 287 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDQAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 288 - protein, 444 aa, Artificial Sequence
  Synthetic
AGAEEIVLQPIKEISGTVKLPGSKSLSNRILLLAALSEGTTVPDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 289 - protein, 444 aa, Artificial Sequence
  Synthetic
AGAEEIVLQPIKEISGTVKLPGSKSLSNRILLLAALSEGTTVQDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 290 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVNVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 291 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVNVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 292 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVNVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 293 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPCEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 294 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPCEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 295 - protein, 444 aa, Artificial Sequence
  Synthetic
AGAEEIVLQPIKEISGTVKLPGSKSLSNRILLLAALSEGTTVVDNLLNSEDVHYMLGALRTLGLSVEADKAAKRAVVVGCGGKFPCEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 296 - protein, 444 aa, Artificial Sequence
  Synthetic
AGAEEIVLQPIKEISGTVKLPGSKSLSNRILLLAALSEGTTVVDNLLNSEDVHGMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 297 - protein, 444 aa, Artificial Sequence
  Synthetic
AGAEEIVLQPIKEISGTVKLPGSKSLSNRILLLAALSEGTTVVDNLLNSEDVHGMLGALRTLGLSVEADKAAKRAVVVGCGGKFPVEDSKEEVQLFLGNAGGAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 298 - protein, 444 aa, Artificial Sequence
  Synthetic
AGAEEIVLQPIKEISGTVKLPGSKSLSQRILLLAALSEGTTVVDNLLNSEDVHYMLGALKTLGLSVEADKMAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 299 - protein, 444 aa, Artificial Sequence
  Synthetic
AGAEEIVLQPIKEISGTVKLPGSKSLSQRILLLAALSEGTTVVDNLLNSEDVHYMLGALKTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 300 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKMAKRAVVVGCGGKFPVEDSKEEVQLFLGNAGTAMRISTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 301 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKMAKRAVVVGCGGKFPVEDSKEEVQLFLGNAGGCMRWLTAAVTAASGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 302 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKMAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 303 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKMAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 304 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKAAKRAVVVGCGGKFPVEDSKEEVQLFLGNAGTAMRISTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 305 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKAAKRAVVVGCGGKFPVEDSKEEVQLFLGNAGGCMRWLTAAVTAASGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 306 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 307 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 308 - protein, 444 aa, Artificial Sequence
  Synthetic
AGAEEIVLQPIKEISGTVKLPGSKSLSTRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 309 - protein, 444 aa, Artificial Sequence
  Synthetic
AGAEEIVLQPIKEISGTVKLPGSKSLSTRILLLAALSEGTTVVDNLLNSEDVHYMLGALKTLGLSVEADKMAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 310 - protein, 444 aa, Artificial Sequence
  Synthetic
AGAEEIVLQPIKEISGTVKLPGSKSLSTRILLLAALSEGTTVVDNLLNSEDVHYMLGALKTLGLSVEADKMAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 311 - protein, 444 aa, Artificial Sequence
  Synthetic
AGAEEIVLQPIKEISGTVKLPGSKSLSTRILLLAALSEGTTVVDNLLNSEDVHYMLGALKTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 312 - protein, 444 aa, Artificial Sequence
  Synthetic
AGAEEIVLQPIKEISGTVKLPGSKSLSTRILLLAALSEGTTVVDNLLNSEDVHYMLGALKTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 313 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGTAMRISTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 314 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGCMRWLTAAVTAASGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 315 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 316 - protein, 444 aa, Artificial Sequence
  Synthetic
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 317 - protein, 444 aa, Artificial Sequence
  Synthetic
AGAEEIVLQPIKEISGTVKLPGSKSLSNRILLLAALSEGTTVVDNLLNSEDVHYMLGALKTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 318 - DNA, 1335 bp, Zea mays
gcgggtgccgaagaaatcgttctgcagccgatcaaagaaatctctggtaccgtgaaactgccgggtagcaaaagcctgagcaaccgtattctgttgcttgcagccctgtcagaaggcaccacggtagttgacaacctgttgaacagtgaagacgtacattacatgctgggtgcactgcgtaccctgggtctgtctgttgaagctgacaaagcagcgaaacgcgcagtagttgtggggtgtggcgggaaattccctgtggaagacagcaaagaagaggtgcagctgttcctgggcaatgccggcaccgcgatgcgtccgctgaccgctgccgttaccgccgcgggtggcaacgcgacttacgtcctggacggtgtaccacgtatgcgtgagcgtccgatcggtgacctggttgtaggtctgaagcagctgggtgctgacgtcgactgcttcctgggtaccgactgccctccggtccgtgttaacggcatcggcggtctgcctggaggcaaagttaaactgtctggtagcattagctcccaatatctgtctgcactgctcatggctgcaccactggcactgggtgacgtcgaaattgagatcatcgataaactgatttccatcccgtacgttgaaatgaccctgcgcctgatggaacgttttggcgtcaaagcggaacactccgattcctgggatcgtttctacatcaaaggtggccagaaatataaatccccgaaaaacgcctacgttgaaggcgacgcttcgtctgcatcctactttctcgctggcgcagctatcaccggcggtacggtaaccgtggagggttgcggcaccacttctctgcagggtgacgttaaatttgccgaagttctggaaatgatgggcgcaaaggttacctggacggaaacttctgttacggtgaccggcccgccgcgcgaaccgtttggtcgtaaacacctgaaggcaatcgatgttaacatgaacaaaatgccggacgttgcaatgaccctggcagtggttgcactgttcgcggatggcccgactgccatccgcgatgtggcctcttggcgcgtgaaggaaaccgagcgtatggtggcgatccgcacagaactgactaaactcggtgcttccgttgaagagggcccggattactgtatcattaccccgccagaaaaactcaacgtgaccgctattgacacctatgatgatcaccgtatggctatggccttctctcttgcggcctgcgcagaggtcccggtagcgattcgtgatccgggttgtactcgcaagactttcccggattatttcgatgtactgtcgactttcgtaaaaaattaa

SEQ ID NO: 319 - DNA, 6368 bp, Zea mays
ggagcttctcctcttagaacgtcgatgaacagtgtagacttattcaatacattaatgtcattttgagatccggcagtaccaaaaaaagcatgccatatgcgaagatctcgtgatgcaactgcttcaagaatcatagtaggaacgcctttgtcaccacgtgtaaacatgccggcccaaccttttgggcaattcttccaagcccaatgcatacagtcaatgcttcctatcatccctggaaaaccacgagactcattttgttgaagtatattttctagctcgtcactccttggaggacgcaagtactctggaccaaagcattctatcacccctttggcaaaatttcccaaacactctaaagccgtgcttgtgccaatcttcaaaacttcatcaagttgatcagctgagctgccatatgcaagcatccgaattgccgcagtacacttttggagtggtgagtggccatctttaccagtgacatctgctcgctgtgtaaaataagaggaccactcaccaagtttttccacaatgcgaagaaaaagcggccttctcatacggaacctcctacggaacatctcgtcggtgtagataggatttgcagagaaataatttgctacaagatcatcatgcgcaccttgtcgattccttggaataactctcctgattccggagaggcgtctgcggcgaggtggattcgatgcttctccatcgattgcaaccttcaaattctcttcgatcttccttccaaattcatctaatatttcatcctcgacaaggaaatcttctaacgtgtaaacttcactgggatccaactcgaaaggatcaaactctccctctggttcgtttgacattgtggatggagtgactaacctgctaacaccctgcaacaatttatacaggagcatatcctcatgcacacgcaaaactgatgttgtccacaagacacgcacaggacacgcaaacagtttcagactcatgcacacgcacatcagtttcagactcaggcacacgcacatcaaatcaccttcgcttgtcgatgagtcgcagccgcatcgtacaatggcgattttaccgacgataaggcatgggagcacgagccgtcgtcgtcgccttgcgagacgacgggagcgatctctcccttcatttaatctcttccacgtcaggttattttgctgagatggcagtatacagacggcaaagttaatgccgttgtacatgcccttagactcttccgtcaccaactcacttagatttttacaacggaacataaggttcgcttgcagacttacatataaggtatagttgcataataatcgccttatgctgtacattgcgacacccgtaaatattcgatgaaatattagtacacaatattaaataagaacgaacaatacatatattatcattgatcttagtatctccttttgctcctcgtagaacaattctgtgtaaattatgcgtaaaattcgaggaccaaaacattggctagaaaaatacctaaaatcagttttgcaattgtttctgattttcctcatattttcttgcttataaagttttccaaaagtaccattttggatgaaaaaacggaaaacaacgctggtctacttgtaaatttggtagtgacatttgggaccgtctagacacgacctaaaaatagtagtctaaaacatagtctgacacgatgccttaaaaatagacgacaaagcacaacacgattagatgtgtcgtgttttgaccgacacgacacaaagtaaggcacgatttaaaacccaataaataatattttaatggttattttatgttccaataattttcatctcttcaaaaaaatgttatagaaatcattgatacttagttgaatatcctaacacaatatatatatatattaatatatatatatcaattttaagtcactttgctagacatagtaatatattttaaatattttctctttcttgtatatttttaaaatacacatcagtttttatatgtgtcgtgcttgaaccgacacgatataatcatcggttcgccgtacttctagatcatgatgttcctaggttttaatattaagagacggtctatattaactcaaaactatttcgtgaaaggctaactcgaaaaaaaaatgaatgtaatcacggcccgtcctggattcgagattctaacgtttcattcgtgtccagtgtgcacacttgtggaaaaggaagacgaagaaaaaaaccaacaactaactccggcccgccggatgcgcccacctacttccccctcgcccctctcatggtctctctcgcgcccagatctgctactagacggcaccgctgcagcgcgtcgtgtcgcgggggttggtggcaggcagcgagagcttgccgttcctctctctcagttgtcaggtcctaggctcacctcaccggctcccagcccgcttctatttcttcctccccgaccccgtgcaggtggcagtccagtccacgccaccaaccgcgaggcgaaccaaaccaacccactctccccaaccccgcgcgcccaggccgcccgccctaccaaccatcggcgtcggcaatggcggccatggcgaccaaggccgccgcgggcaccgtgtcgctggacctcgccgcgccgtcgcgccgccaccaccgcccgagctcggcgcgcccgcccgcccgccccgccgtccgcgggctgcgggcgcctgggcgccgcgtgatcgccgcgccgccggcggcggcagcggcggcggcggtgcaggcgggtgccgaggagatcgtgctgcagcccatcaaggagatctccggcaccgtcaagctgccggggtccaagtcgctttccaaccggatcctcctgctcgccgccctgtccgaggtgagcgattttggtgcttgctgcgctgccctgtctcactgctacctaaatgttttgcctgtcgaataccatggattctcggtgtaatccatctcacgatcagatgcaccgcatgtcgcatgcctagctctctctaatttgtctagtagtttgtatacggattaatattgataaatcggtaccgcaaaagctaggtgtaaataaacactagaaaattggatgttcccctatcggcctgtactcggctactcgttcttgtgatggcatgctgtctcttcttggtgtttggtgaacaaccttatgaaatttgggcgcaaagaactcgccctcaagggttgatcttatgccatcgtcatgataaacagtggagcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaactgcaatgcggccattgacagcagctgttactgctgctggtggaaatgcaacgtatgtttcctctctttctctctacaatacttgctggagttagtatgaaacccatgggtatgtctagtggcttatggtgtattggtttttgaacttcagttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggttagctactaagggccacatgttacattcttctgtaaatggtacaactattgtcgagcttttgcatttgtaaggaaagcattgattgatctgaatttgatgctacaccacaaaatatcctacaaatggtcatccctaactagcaaacaatgaagtaatacttggcatgtgtttatcaaattaatttccatcttctggggcattgcctgttttctagtctaatagcatttgtttttagcattaattagctcttacaattgttatgttctacaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtaagctctgtaatgtatttcactactttgatgccaatgtttcagttttcagttttccaaacagtcgcatcaatatttgaatagatgcactgtagaaaaaaaatcattgcagggaaaaactagtactgagtattttgactgtaaattattttaccagtcggaatatagtcagtctattggagtcaagagcgtgaaccgaaatagccagttaattatcccattatacagaggacaaccatgtatactattgaaacttggtttataagagaatctaggtagctggactcgtagctgcttggcatggataccttcttatctttaggaaaagacacttgatttttttttttctgtggccctctatgatgtgtgaacctgcttctctattgctttagaaggatatatctatgtcgttatgcaacatgcttcccttagccatttgtactgaaatcagtttcataagttcgttagtggttccctaaacgaaaccttgtttttctttgcaatcaacaggtcccctaaaaatgcctatgttgaaggtgatgcctcaagcgcaagctatttcttggctggtgctgcaattactggagggactgtgactgtggaaggttgtggcaccaccagtttgcaggtaaagatttcttggctggtgctacaataactgcttttgtctttttggtttcagcattgttctcagagtcactaaataacattatcatctgcaaatgtcaaatagacatacttaggtgaattcatgtaaccgtttccttacaaatttgctgaaacctcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacggtaaaacattctcagccctacaaccatgcctcttctacatcactacttgacaagactaaaaactattggctcgttggcagtggcttcctggagagtaaaggagaccgagaggatggttgcgatccggacggagctaaccaaggtaaggctacatacttcacatgtctcacgtcgtctttccatagctcgctgcctcttagcggcttgcctgcggtcgctccatcctcggttgctgtctgtgttttccacagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtggccatccgggaccctgggtgcacccggaagaccttccccgactacttcgatgtgctgagcactttcgtcaagaattaataaagcgtgcgatactaccacgcagcttgattgaagtgataggcttgtgctgaggaagtacatttcttttgttctgttttttctctttcacgggattaagttttgagtctgtaacgttagttgtttgtagcaagtttctatttcggatcttaagtttgtgcactgcaagccaaatttcatttcaagagtggttcgttggaataataagaataataaattacgtttcagtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccatgtgtagtatgttctttctttgagtctcatttaactacctctacacataccaactttagttttttttctacctcttcatgttactatggtgccttcttatcccactgagcattgg

SEQ ID NO: 320 - protein, 444 aa, Zea mays
AGAEEIVLQPIKEISGTVKLPGSKSLSCRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 321 - protein, 444 aa, Zea mays
AGAEEIVLQPIKEISGTVKLPGSKSLSHRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 322 - protein, 444 aa, Zea mays
AGAEEIVLQPIKEISGTVKLPGSKSLSSRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 323 - protein, 444 aa, Zea mays
AGAEEIVLQPIKEISGTVKLPGSKSLSVRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 324 - protein, 444 aa, Zea mays
AGAEEIVLQPIKEISGTVKLPGSKSLSNRILLEAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 325 - protein, 444 aa, Zea mays
AGAEEIVLQPIKEISGTVKLPGSKSLSNRILLLAALSEKTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 326 - protein, 444 aa, Zea mays
AGAEEIVLQPIKEISGTVKLPGSKSLSNRILLLAALSEGTTVVDGLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 327 - protein, 444 aa, Zea mays
AGAEEIVLQPIKEISGTVKLPGSKSLSNRILLLAALSEGTTVVDNCLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 328 - protein, 444 aa, Zea mays
AGAEEIVLQPIKEISGTVKLPGSKSLSNRILLLAALSEGTTVVDNWLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 329 - protein, 444 aa, Zea mays
AGAEEIVLQPIKEISGTVKLPGSKSLSNRILLLAALSEGTTVVDNLLNSEDVHYMEGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 330 - protein, 444 aa, Zea mays
AGAEEIVLQPIKEISGTVKLPGSKSLSNRILLLAALSEGTTVVDNLLNSEDVHYMKGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 331 - protein, 444 aa, Zea mays
AGAEEIVLQPIKEISGTVKLPGSKSLSNRILLLAALSEGTTVVDNLLNSEDVHYMLGALQTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 332 - protein, 444 aa, Zea mays
AGAEEIVLQPIKEISGTVKLPGSKSLSNRILLLAALSEGTTVVDNLLNSEDVHYMLGALRTFGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 333 - protein, 444 aa, Zea mays
AGAEEIVLQPIKEISGTVKLPGSKSLSNRILLLAALSEGTTVVDNLLNSEDVHYMLGALRTLLLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 334 - protein, 444 aa, Zea mays
AGAEEIVLQPIKEISGTVKLPGSKSLSNRILLLAALSEGTTVVDNLLNSEDVHYMLGALRTLGGSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 335 - protein, 444 aa, Zea mays
AGAEEIVLQPIKEISGTVKLPGSKSLSNRILLLAALSEGTTVVDNLLNSEDVHYMLGALRTLGLQVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 336 - protein, 444 aa, Zea mays
AGAEEIVLQPIKEISGTVKLPGSKSLSNRILLLAALSEGTTVVDNLLNSEDVHYMLGALRTLGLRVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 337 - protein, 444 aa, Zea mays
AGAEEIVLQPIKEISGTVKLPGSKSLSNRILLLAALSEGTTVVDNLLNSEDVHYMLGALRTLGLSVEADLAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 338 - protein, 444 aa, Zea mays
AGAEEIVLQPIKEISGTVKLPGSKSLSNRILLLAALSEGTTVVDNLLNSEDVHYMLGALRTLGLSVEADKAAPRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 339 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAATAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 340 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAETAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 341 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 342 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGLAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 343 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGQAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 344 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGVAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 345 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTCMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 346 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTDMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 347 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTGMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 348 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTIMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 349 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTLMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 350 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTPMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 351 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTRMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 352 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMAPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 353 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRCLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 354 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRGLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 355 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRILTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 356 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRLLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 357 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRQLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 358 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 359 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRTLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 360 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRVLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 361 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRWLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 362 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPATAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 363 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPCTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 364 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPFTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 365 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPGTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 366 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPKTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 367 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPMTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 368 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPQTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 369 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPSTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 370 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 371 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPWTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 372 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVVAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 373 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVWAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 374 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTACGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 375 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAASGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 376 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNFTYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 377 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVDDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 378 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDKVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 379 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGDPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 380 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPMGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 381 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLDADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 382 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAALLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 383 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLTLGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 384 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTNSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 385 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAIVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 386 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVIMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 387 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEMGPDYCIITPPEKLNVTAIDTYDDHRMAMAFSLAACAEVPVAIRDPGCTRKTFPDYFDVLSTFVKN

SEQ ID NO: 388 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVENGPDYCIITPPEKLNVTAIDTYDDHRMAMAFSLAACAEVPVAIRDPGCTRKTFPDYFDVLSTFVKN

SEQ ID NO: 389 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDECIITPPEKLNVTAIDTYDDHRMAMAFSLAACAEVPVAIRDPGCTRKTFPDYFDVLSTFVKN

SEQ ID NO: 390 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGTAMRPLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVGVAIRDPGCTRKTFPDYFDVLSTFVKN

SEQ ID NO: 391 - protein, 444 aa, Zea mays
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGGVMRLVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 392 - protein, 444 aa, Zea mays
AGAEEIVLQPIKEISGMVKLPGSKSLSNRILLLAALSEGTTVVDNLLNSEDVHYMLGALRTLGLSVEADKMAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 393 - protein, 444 aa, Zea mays
AGAEEIVLQPIKEISGTVKLPGSKSLSHRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 394 - protein, 444 aa, Zea mays
AGAEEIVLQPIKEISGTVKLPGSKSLSQRILLLAALSEGTTVVDNLLNSEDVHYMLGALRTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 395 - protein, 444 aa, Zea mays
AGAEEIVLQPIKEISGTVKLPGSKSLSNRILLLAALSEGTTVVDNLLNSEDVHYMLGALETLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTNSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 396 - protein, 444 aa, Zea mays
AGAEEIVLQPIKEISGTVKLPGSKSLSSRILLLAALSEGTTVVDNLLNSEDVHYMLGALRTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 397 - protein, 444 aa, Zea mays
AGAEEIVLQPIKEISGTVKLPGSKSLSHRILLLAALSEGTTVVDNLLNSEDVHYMLGALRTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 398 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGVMRLVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 399 - protein, 444 aa, Zea mays
AGAEEIVLQPIKEISGMVKLPGSKSLSNRILLLAALSEGTTVVDNLLNSEDVHYMLGALRTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 400 - protein, 444 aa, Zea mays
AGAEEIVLQPIKEISGTVKLPGSKSLSNRILLLAALSEGTTVVDNLLNSEDVHYMLGALKTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 401 - protein, 444 aa, Zea mays
AGAEEIVLQPIKEISGMVKLPGSKSLSQRILLLAALSEGTTVVDNLLNSEDVHYMLGALKTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 402 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGCVTVEGCGTNSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 403 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGRMRCLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 404 - protein, 444 aa, Zea mays
AGAEEIVLQPIKEISGTVKLPGSKSLSNRILLLAALSEGTTVVDNLLNSEDVHYMLGALRTLGLKVEADKMAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 405 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGAMRSLTAAVTAAGGNATYVLDGDPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 406 - protein, 444 aa, Zea mays
AGAEEIVLQPIKEISGTVKLPGSKSLSNRILLLAALSEGTTVVDNLLNSEDVHYMLGALKTLGLSVEADKAAKRAVVVGCGGKFPVEDSKEEVQLFLGNAGGAMRSLTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVENGPDYCIITPPEKLNVTAIDTYDDHRMAMAFSLAACAEVPVAIRDPGCTRKTFPDYFDVLSTFVKN

SEQ ID NO: 407 - protein, 444 aa, Zea mays
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVENGPDYCIITPPEKLNVTAIDTYDDHRMAMAFSLAACAEVPVAIRDPGCTRKTFPDYFDVLSTFVKN

SEQ ID NO: 408 - protein, 444 aa, Zea mays
AGAEEIVLQPIKEISGTVKLPGSKSLSNRILLLAALSEGTTVVDNLLNSEDVHYMLGALRTLGLSVEADKMAKRAVVVGCGGKFPVEDSKEEVQLFLGNAGGVMRSVTAAVTAAGGNATYVLDGDPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 409 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAGGCMRWLTAAVTAASGNATYVLDGVPRMRERPIGDLVVGLKQLGADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 410 - protein, 444 aa, Zea mays
AGAEEIVLQPIKEISGMVKLPGSKSLSQRILLLAALSEGTTVVDNLLNSEDVHYMLGALKTLGLSVEADKMAKRAVVVGCGGKFPVEDSKEEVQLFLGNAGGVMRSVTAAVTAAGGNATYVLDGVPRMRERPIGDLVVGLKQLGADVDCFLGTDCPPVRVNGIGGLPGGKVKLSGSISSQYLSALLMAAPLALGDVEIEIIDALISIPYVEMTLRLMERFGVKAEHSDSWDRFYIKGGQKYKSPKNAYVEGDASSASYFLAGAAITGGCVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVLEGPDYCIITPPEKLNVTAIDTYDDHRMAMAFSLAACAEVPVAIRDPGCTRKTFPDYFDVLSTFVKN

SEQ ID NO: 411 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAATAMRPLTAAVTAAGGNATYVLDGVPRMRERPIGDLVVGLKQLDADVDCFLGTDCPPVRVNGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

SEQ ID NO: 412 - protein, 444 aa, Zea mays
AGAEEIVLQPIKEISGTVKLPGSKSLSNRILLLAALSEGTTVVDNLLNSEDVHYMLGALRTLGLSVEADKAAKRAVVVGCGGKFPVEDSKEEVQLFLGNAATAMRPLTAAVTAAGGNATYVLDGVPRMRERPIGDLVVGLKQLGADVDCFLGTDCPPVRVNGIGGLPGGKVKLSGSISSQYLSALLMAAPLTLGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPREPFGRKHLKAIDVNMNKMPDVAMTLAVVALFADGPTAIRDVASWRVKETERMVAIRTELTKLGASVEEGPDYCIITPPEKLNVTAIDTYDDHRMAMAFSLAACAEVPVAIRDPGCTRKTFPDYFDVLSTFVKN

The invention claimed is:

1. A recombinant DNA molecule comprising a polynucleotide encoding a glyphosate-tolerant EPSPS, wherein the EPSPS comprises at least 2 amino acid substitutions, wherein the at least 2 amino acid substitutions are selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60K, R60Q, T61E, L62F, G63L, L64G, S65K, S65Q, S65R, E67C, K70L, K70W, A71M, K73P, V77N, G82Q, V86C, G101A, G101E, T102F, T102G, T102L, T102Q, T102V, A103C, A103D, A103F, A103G, A103I, A103L, A103P, A103R, A103V, R105A, P106A, P106C, P106G, P106I, P106L, P106Q, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1, wherein polynucleotide is operably linked to a heterologous promoter.

2. The recombinant DNA molecule of claim 1, wherein the glyphosate-tolerant EPSPS is a glyphosate-tolerant maize EPSPS.

3. The recombinant DNA molecule of claim 1, wherein the EPSPS comprises at least 3, at least 4, at least 5, at least 6, or at least 7 of the amino acid substitutions.

4. The recombinant DNA molecule of claim 1, wherein the EPSPS comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

5. The recombinant DNA molecule of claim 1, wherein the EPSPS confers increased tolerance to glyphosate as compared to a wild-type EPSPS.

6. The recombinant DNA molecule of claim 2, wherein the EPSPS confers increased tolerance to glyphosate as compared to a wild-type maize EPSPS.

7. A plant, seed, plant tissue, plant part, or cell comprising the recombinant DNA molecule of claim 1.

8. The plant, seed, plant tissue, plant part, or cell of claim 7, wherein the EPSPS comprises at least 3, at least 4, at least 5, at least 6, or at least 7 of the amino acid substitutions.

9. The plant, seed, plant tissue, plant part, or cell of claim 7, wherein the EPSPS comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-

P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

10. A plant, seed, plant tissue, plant part, or cell comprising a glyphosate-tolerant EPSPS encoded by the recombinant DNA molecule of claim 1.

11. A glyphosate-tolerant EPSPS comprising at least 2 amino acid substitutions, wherein the at least 2 amino acid substitutions are selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60Q, T61E, L62F, G63L, L64G, S65K, S65Q, S65R, E67C, K70L, K70W, A71M, K73P, V77N, G82Q, V86C, G101A, G101E, T102F, T102G, T102L, T102Q, T102V, A103C, A103D, A103F, A103G, A103I, A103L, A103P, A103R, A103V, R105A, P106A, P106C, P106G, P106I, P106L, P106Q, P106V, P106W, L107A, L107C, L107F, L107G, L107K, L107M, L107Q, L107S, L107T, L107V, L107W, V111N, V111Q, T112V, T112W, A114C, A114K, G115A, A118F, L122D, G124K, V125D, E130R, P132D, I133M, G144D, V160P, N161W, K170V, S179I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1, wherein the EPSPS confers increased tolerance to glyphosate as compared to a wild-type EPSPS.

12. The glyphosate-tolerant EPSPS of claim 11, wherein the EPSPS comprises an amino acid substitution combination selected from the group consisting of: A103 G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-

T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E 130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-

A71M-T102G-A103V-P106S-L107V-K203A-T269C-E378L, G101A-G144D, and G101A-A192T.

13. A method for conferring glyphosate tolerance to a plant comprising expressing in the plant the glyphosate-tolerant EPSPS of claim 11.

14. A method for producing a glyphosate-tolerant EPSPS comprising introducing into a plant EPSPS at least 2 amino acid substitutions, wherein the at least 2 amino acid substitutions are selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60Q, T61E, L62F, G63L, L64G, S65K, S65Q, S65R, E67C, K70L, K70W, A71M, K73P, V77N, G82Q, V86C, G101A, G101E, T102F, T102G, T102L, T102Q, T102V, A103C, A103D, A103F, A103G, A103I, A103L, A103P, A103R, A103V, R105A, P106A, P106C, P106G, P106I, P106L, P106Q, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S179I, P190L, L191D, A192T, G194Q, K203A, R219F, T269C, T278N, L280D, K280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1, wherein the EPSPS confers increased tolerance to glyphosate as compared to a wild-type EPSPS.

15. The method of claim 14, wherein the method comprises introducing least 3, at least 4, at least 5, at least 6, or at least 7 of the amino acid substitutions.

16. The method of claim 14, wherein the method comprises introducing an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-

P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

17. A method for producing a glyphosate-tolerant plant comprising: (i) introducing into the genome of a plant cell two or more changes to a polynucleotide encoding a EPSPS, wherein the two or more changes produce a glyphosate-tolerant EPSPS and wherein the two or more changes result in at least 2 amino acid substitutions, wherein the at least 2 amino acid substitutions are selected from the group consisting of: I6P, I6W, T17M, N28A, N28C, N28G, N28H, N28M, N28Q, N28S, N28T, N28V, L33E, A35M, L36E, E38F, G39K, G39W, T41H, V43P, V43Q, N45G, L46C, L46D, L46W, E50F, Y54G, L56E, L56K, A58I, R60E, R60Q, T61E, L62F, G63L, L64G, S65K, S65Q, S65R, E67C, K70L, K70W, A71M, K73P, V77N, G82Q, V86C, G101A, G101E, T102F, T102G, T102L, T102Q, T102V, A103C, A103D, A103F, A103G, A103I, A103L, A103P, A103R, A103V, R105A, P106A, P106C, P106G, P106I, P106L, P106Q, P106V, P106W, L107A, L107C, L107F, L107G, L107K, L107M, L107Q, L107S, L107T, L107V, L107W, V111N, V111Q, T112V, T112W, A114C, A114K, G115S, A118F, L122D, G124K, V125D, E130R, P132D, I133M, G144D, V160P, N161W, K170V, S719I, P190L, L191D, A192T, G194Q, K203A, R219F, T269C, T278N, L280D, L280R, E288I, A295F, V297Q, T307W, G315K, M326A, K328F, D331M, V332K, V332Q, A333I, A340Y, R350K, E378L, E378W, E379M, E379N, Y383E, P418G, and C426M, wherein the position of the amino acid substitution is relative to the position of the amino acid in the sequence provided as SEQ ID NO:1; and (ii) regenerating a glyphosate-tolerant plant from the plant cell, wherein the EPSPS confers increased tolerance to glyphosate as compared to a wild-type EPSPS.

18. The method of claim 17, wherein the method comprises introducing at least 3, at least 4, at least 5, at least 6, or at least 7 of the amino acid substitutions.

19. The method of claim 17, wherein the EPSPS comprises an amino acid substitution combination selected from the group consisting of: A103G-P106L-L107M, A71M-T102G-P106S, A71M-T102G-P106W, A71M-T102I-P106A, E38F-T102G-P106S, E38F-T102G-P106W, E50F-T102G-P106S, E50F-T102G-P106W, E50F-T102I-P106A, G101E-T102G-P106S, G101E-T102G-P106W, G101E-T102I-P106A, G39K-T102I-P106A, G39W-T102G-P106S, G39W-T102G-P106W, G63L-T102I-P106A, I6P-R60E-T102G-P106S-E130R, I6P-R60E-T102G-P106S-E130R-E378L, I6P-R60E-T102G-P106S-E130R-L280D, I6P-R60E-T102G-P106S-E378L, I6P-R60E-T102G-P106S-L280D, I6P-R60E-T102G-P106S-L280D-E378L, I6P-R60E-T102G-P106W, I6P-R60E-T102G-P106W-E130R, I6P-R60E-T102G-P106W-E130R-E378L, I6P-R60E-T102G-P106W-E130R-L280D, I6P-R60E-T102G-P106W-E378L, I6P-R60E-T102G-P106W-L280D, I6P-R60E-T102G-P106W-L280D-E378L, I6P-T102G-P106S, I6P-T102G-P106S-E130R, I6P-T102G-P106S-E130R-E378L, I6P-T102G-P106S-E130R-L280D, I6P-T102G-P106S-E130R-L280D-E378L, I6P-T102G-P106S-E378L, I6P-T102G-P106S-L280D, I6P-T102G-P106S-L280D-E378L, I6P-R60E-T102G-P106S, I6P-T102G-P106W, I6P-T102G-P106W-E130R, I6P-T102G-P106W-E 130R-E378L, I6P-T102G-P106W-E130R-L280D, I6P-T102G-P106W-E130R-L280D-E378L, I6P-T102G-P106W-E378L, I6P-T102G-P106W-L280D, I6P-T102G-P106W-L280D-E378L, K70L-T102G-P106S, K70L-T102G-P106W, K70L-T102I-P106A, K70W-T102G-P106S, K70W-T102G-P106W, K73P-T102G-P106S, K73P-T102G-P106W, K73P-T102I-P106A, L33E-T102I-P106A, L36E-T102G-P106S, L36E-T102G-P106W, L46C-T102I-P106A, L46D-T102G-P106S, L46D-T102G-P106W, L46D-T102I-P106A, L46W-T102I-P106A, L56E-T102G-P106S, L56E-T102G-P106W, L56E-T102I-P106A, L56K-T102G-P106S, L56K-T102G-P106W, L56K-T102I-P106A, L62F-T102G-P106S, L62F-T102G-P106W, L62F-T102I-P106A, L64G-T102G-P106S, L64G-T102G-P106W, L64G-T102I-P106A, N28A-T102G-P106S, N28A-T102G-P106W, N28A-T102I-P106A, N28C-T102G-P106S, N28C-T102G-P106W, N28C-T102I-P106A, N28G-T102G-P106S, N28G-T102G-P106W, N28G-T102I-P106A, N28M-T102G-P106S, N28M-T102G-P106W, N28M-T102I-P106A, N28Q-R60K-A71M-T102G-P106S-K203A-T269C-E378L, N28Q-R60K-T102G-P106S-E378L, N28Q-T102G-P106S, N28Q-T102G-P106W, N28Q-T102I-P106A, N28S-T102G-P106S, N28S-T102G-P106W, N28S-T102I-P106A, N28T-R60E-A71M-P106I-L107S-K203A-T269C-E378L, N28T-R60E-A71M-T102G-A103C-P106W-G115S-K203A-T269C-E378L, N28T-R60E-A71M-T102G-A103V-P106S-L107V-K203A-T269C-E378L, N28T-R60E-A71M-T102G-P106S-K203A-T269C-E378L, N28T-R60E-P106I-L107S-E378L, N28T-R60E-T102G-A103C-P106W-G115S-E378L, N28T-R60E-T102G-A103V-P106S-L107V-E378L, N28T-R60E-T102G-P106S-E378L, N28T-R60E-T102G-P106S-K203A-E378L, N28T-R60K-A71M-T102G-P106S-E378L, N28T-R60K-A71M-T102G-P106S-K203A-T269C-E378L, N28T-R60K-T102G-P106S-E378L, N28T-R60K-T102G-P106S-T269C-E378L, N28T-T102G-P106S, N28T-T102G-P106W, N28T-

T102I-P106A, N28V-T102G-P106S, N28V-T102G-P106W, N28V-T102I-P106A, N45G-T102I-P106A, P106I-L107S, R60E-P106I-L107S-E378L, R60E-T102G-A103C-P106W-G115S-E378L, R60E-T102G-A103V-P106S-L107V-E378L, R60E-T102G-P106S, R60E-T102G-P106S-E130R-E378L, R60E-T102G-P106S-E130R-L280D, R60E-T102G-P106S-E130R-L280D-E378L, R60E-T102G-P106S-E378L, R60E-T102G-P106S-L280D, R60E-T102G-P106S-L280D-E378L, R60E-T102G-P106W, R60E-T102G-P106W-E130R, R60E-T102G-P106W-E130R-E378L, R60E-T102G-P106W-E130R-L280D, R60E-T102G-P106W-E130R-L280D-E378L, R60E-T102G-P106W-E378L, R60E-T102G-P106W-L280D, R60E-T102G-P106W-L280D-E378L, R60E-T102I-P106A, R60K-T102G-P106S, R60K-T102G-P106S-E378L, R60K-T102G-P106W, R60Q-T102I-P106A, S65K-T102G-P106S, S65K-T102G-P106W, S65Q-T102I-P106A, S65R-T102G-P106S, S65R-T102G-P106W, S65R-T102I-P106A, T102G-A103C-P106W, T102G-A103D-P106S, T102G-A103D-P106W, T102G-A103V-P106S-L107V, T102G-P106S, T102G-P106S-A114K, T102G-P106S-A295F, T102G-P106S-E130R, T102G-P106S-E130R-E378L, T102G-P106S-E130R-L280D, T102G-P106S-E130R-L280D-E378L, R60E-T102G-P106S-E130R, T102G-P106S-E378L, T102G-P106S-E379M, T102G-P106S-G194Q, T102G-P106S-K203A, T102G-P106S-L107K, T102G-P106S-L280D, T102G-P106S-L280D-E378L, T102G-P106S-L280R, T102G-P106S-N161W, T102G-P106S-P132D, T102G-P106S-P418G, T102G-P106S-S179I, T102G-P106S-T112V, T102G-P106S-T269C, T102G-P106S-T307W, T102G-P106S-V111N, T102G-P106S-V160P, T102G-P106S-V297Q, T102G-P106S-V332K, T102G-P106S-Y383E, Y54G-T102G-P106S, T102G-P106W, T102G-P106W-A114K, T102G-P106W-A295F, T102G-P106W-E130R, T102G-P106W-E130R-E378L, T102G-P106W-E130R-L280D, T102G-P106W-E130R-L280D-E378L, T102G-P106W-E378L, T102G-P106W-E379M, T102G-P106W-G194Q, T102G-P106W-K203A, T102G-P106W-L107K, T102G-P106W-L280D, T102G-P106W-L280D-E378L, T102G-P106W-L280R, T102G-P106W-N161W, T102G-P106W-P132D, T102G-P106W-P418G, T102G-P106W-S179I, T102G-P106W-T112V, T102G-P106W-T269C, T102G-P106W-T307W, T102G-P106W-V111N, T102G-P106W-V160P, T102G-P106W-V297Q, T102G-P106W-V332K, T102G-P106W-Y383E, T102G-R105A-P106S, T102G-R105A-P106W, T102I-A103D-P106A, T102I-A103V-P106G-L107T, T102I-A103V-P106S, T102I-P106A, T102I-P106A-A114C, T102I-P106A-A118F, T102I-P106A-E288I, T102I-P106A-E379M, T102I-P106A-G124K, T102I-P106A-L107K, T102I-P106A-L122D, T102I-P106A-L280R, T102I-P106A-P418G, T102I-P106A-S179I, T102I-P106A-T112V, T102I-P106A-T112W, T102I-P106A-T307W, T102I-P106A-Y383E, T102I-P106S-L107G, T102I-P106T, T102I-R105A-P106A, T102L-A103L-P106S-L107W, T102L-A103L-P106V-L107Q, T102L-A103V-P106C-L107C, T102L-A103V-P106Q-L107S, T102L-A103V-P106S-L107G, T102L-A103V-P106S-L107M, T102L-P106V, T102Q-A103P-P106A-L107F, T102V-A103I-P106T-L107C, T102V-A103V-P106A-L107Q, T102V-A103V-P106C-L107F, T102V-P106S, T102V-P106S-L107A, T41H-T102G-P106S, T41H-T102G-P106W, T61E-T102G-P106S, T61E-T102G-P106W, T61E-T102I-P106A, V77N-T102G-P106S, V77N-T102G-P106W, V86C-T102G-P106S, V86C-T102G-P106W, Y54G-T102G-P106W, A71M-T102G-A103V-P106L-L107V, T17M-A71M-T102G-A103V-P106S-L107V, N28H-T102G-P106S, N28Q-T102G-A103V-P106S-L107V, R60E-T102G-A103V-P106S-L107V-T278N-E378L, N28S-T102G-A103V-P106S-L107V, N28H-T102G-A103V-P106S-L107V, T102G-A103V-P106L-L107V-T269C, T17M-T102G-A103V-P106S-L107V-T269C, R60K-T102G-A103V-P106S-L107V-T269C-E378L, T17M-N28Q-R60K-T102G-A103V-P106S-L107V-E378L, T102G-A103V-P106S-L107V-T269C-T278N, T102G-A103R-P106C, S65K-A71M-T102G-A103V-P106S-L107V, T102G-P106S-V125D, R60K-T102G-P106S-E379N, A71M-T102G-A103V-P106S-L107V-E379N, A71M-T102G-A103V-P106S-L107V-V125D, T102G-A103C-P106W-G115S, T17M-N28Q-R60K-A71M-T102G-A103V-P106S-L107V-K203A-T269C-E378L, G101A-G144D, and G101A-A192T.

20. A method for controlling weeds in a plant growth area, comprising contacting a plant growth area comprising the plant or seed of claim 7 with glyphosate, wherein the plant or seed is tolerant to glyphosate, and wherein weeds are controlled in the plant growth area.

* * * * *